US011628214B2

(12) United States Patent
Nikolin et al.

(10) Patent No.: US 11,628,214 B2
(45) Date of Patent: Apr. 18, 2023

(54) IMMUNOGENIC COMPOSITIONS AND VACCINES COMPRISING AFRICAN SWINE FEVER VIRUS PEPTIDES AND PROTEINS AND USES THEREOF

(71) Applicant: Boehringer Ingelheim Vetmedica GmbH, Ingelheim am Rhein (DE)

(72) Inventors: Veljko Nikolin, Hannover (DE); Egbert Siegfried Mundt, Isernhagen (DE); Fernando Rodriguez Gonzalez, Barcelona (ES); Laia Bosch Camos, Barcelona (ES); Javier Alonso Collado Miguens, Barcelona (ES)

(*) Notice: Subject to any disclaimer, the term of this patent is extended or adjusted under 35 U.S.C. 154(b) by 140 days.

(21) Appl. No.: 16/830,412

(22) Filed: Mar. 26, 2020

(65) Prior Publication Data

US 2020/0306360 A1 Oct. 1, 2020

(30) Foreign Application Priority Data

Mar. 27, 2019 (EP) .................................... 19382216

(51) Int. Cl.
*A61K 39/12* (2006.01)
*C12N 15/86* (2006.01)
*C12N 15/74* (2006.01)
*A61K 39/00* (2006.01)

(52) U.S. Cl.
CPC ............ *A61K 39/12* (2013.01); *C12N 15/746* (2013.01); *C12N 15/86* (2013.01); *A61K 2039/552* (2013.01); *C12N 2710/12022* (2013.01)

(58) Field of Classification Search
None
See application file for complete search history.

(56) References Cited

U.S. PATENT DOCUMENTS

2017/0136114 A1* 5/2017 Abrams .................... C12N 7/00
2020/0306360 A1* 10/2020 Nikolin .................. C07K 14/01

FOREIGN PATENT DOCUMENTS

| CN | 104262484 | 1/2015 |
| WO | 2015091322 | 6/2015 |
| WO | 2017096341 | 6/2017 |
| WO | 2020060403 | 3/2020 |
| WO | 2020102370 | 5/2020 |

OTHER PUBLICATIONS

Cadenas-Fernandez et al. (Pathogens. 2020; 9 (3): 171).*
Alignment with Seq ID 570 with UniProtdb access No. 1002L_ASFWA 2009.*
Alignment with Seq ID 572 with UniProtdb access No. 1002L_ASFWA 2009.*
Machuka et al. (BMC Genomics. 2022; 23: 522).*
UniProt db VF145_ASFB7 2009 sequence alignment of Seq ID 514.*
Jason Farlow et al.: "Intra-epidemic genome variation in highly pathogenic African swine fever virus (ASFV) from the country of Georgia"; Virology Journal; vol. 15; No. 1; Dec. 1, 2018; s12985-018-1099-z.
Database UniProt, Sep. 12, 2018; A118R; A0A2X0RVA9.
De Villiers E P et al.: "Phylogenomic analysis of 11 complete African swine fever virus genome sequences" Virology ; vol. 400, No. 1; Apr. 25, 2010; p. 128-136.
Paula L Monteagudo et al.: "BA71 CD2: a new recombinant live attenuated African swine fever virus with Cross-Protective Capabilities"; Journal of Virology; Oct. 1, 2017; e01058-17.
Elena G Sanchez et al.: "Development of vaccines against ASFV"; Virus Research ; vol. 265, May 1, 2019; p. 150-155.
Argilaguet JM et al.: "Enhancing DNA immunization by targeting ASFV antigens to SLA-II bearing cells"; Vaccine 2011, 29: 5379-85.
Argilaguet JM et al.: "DNA vaccination partially protects against African swine fever virus lethal challenge in the absence of antibodies"; PLoS One 2012, 7: e40942.
Calis J et al.: "Properties of MHC Class I Presented Peptides That Enhance Immunogenicity": PLoS Comput. Biol. 2013, 9: e1003266.
Chapman DA et al.: "Genomic Analysis of Highly Virulent Georgia 2007/1 Isolate of African Swine Fever Virus"; Emerg Infect Dis. 2011, 17(4): 599-605.
Galindo-Cardiel I et al.: "Standardization of pathological investigations in the framework of experimental ASFV Infections"; Virus Res 2013, 173: 180-190.
Gallardo C et al.: "Comparative evaluation of novel African swine fever virus (ASF) antibody detection techniques derived from specific ASF viral genotypes with the OIE internationally prescribed serological tests"; Vet Microbiol 2013, 162: 32-43.
Jancovich JK et al.: "Immunization of Pigs by DNA Prime and Recombinant Vaccinia Virus Boost to Identify and Rank African Swine Fever Virus Immunogenic and Protective Proteins"; J Virol 2018, 92(8): e02219-17.
Jenson JS et al.: "The cellular immune recognition of proteins expressed by an African swine fever virus random genomic library"; J Immunol Methods 2000, 242: 33-42.
Lacasta A et al.: "Expression library immunization can confer protection against lethal challenge with African swine fever virus"; J Virol 2014, 88: 13322-13332.
Lopera-Madrid J et al.: "Safety and immunogenicity of mammalian cell derived and Modified Vaccinia Ankara vectored African swine fever subunit antigens in swine"; Vet Immunol Immunopthol 2017, 185: 20-33.
Netherton CL et al.: "Identification and Immunogenicity of African Swine Fever Virus Antigens"; Front Immunol. 2019 (10) : 1318.
O'Donnell V et al.: "African Swine Fever Virus Georgia Isolate Harboring Deletions of MGF360 and MGF505 Genes Is Attenuated in Swine and Confers Protection against Challenge with Virulent Parental Virus"; J Virol 2015, 89: 6048-6056.

(Continued)

*Primary Examiner* — Shanon A. Foley
(74) *Attorney, Agent, or Firm* — Steffan Finnegan

(57) ABSTRACT

The present invention relates to African swine fever virus (ASFV) peptides and/or polypeptides as well as immunogenic fragments thereof, corresponding encoding AFSV oligonucleotides and/or polynucleotides as well as immunogenic fragments thereof, immunogenic compositions, vaccines and uses thereof.

9 Claims, 3 Drawing Sheets
Specification includes a Sequence Listing.

(56) References Cited

OTHER PUBLICATIONS

Rodriguez F et al.: "Two Overlapping Subdominant Epitopes Identified by DNA Immunization Induce Protective CD8+ T-Cell Populations with Differing Cytolytic Activities"; J Virol 2001, 75: 7399-7409.
Rodriguez JM et al.: "Genome Sequence of African Swine Fever Virus BA71, the Virulent Parental Strain of the Nonpathogenic and Tissue-Culture Adapted BA71V"; PLoS One 2015; 10(11): e0142889.
Rodriguez F and Whitton JL: "Enhancing DNA immunization"; Virology 2000, 268: 233-238.
Velders MP et al.: "Defined Flanking Spacers and Enhanced Proteolysis is Essential for Eradication of Established Tumors by an Epitope String DNA Vaccine"; J Immunol 2001, 166: 5366-5373.
Yanez R., et al.: "Two putative African Swine Fever Virus helicases similar to yeast 'DEAH' pre-mRNA processing proteins and vaccinia virus ATPases D11L and D6R" Gene, vol. 134; No. 2, 1993, pp. 161-174.
Database UniProt Accession No. Q89525, May 5, 2009 (ISA).
Alonso F. et al.: African swine fever virus-specific cytotoxic T lymphocytes recognize the 32 kDa immediate early protein (vp32). Virus Res. 1997;49(2):123-30.
Ivanov V., et al.: "Vaccination with viral protein-mimicking peptides postpones mortality in domestic pigs infected by African swine fever virus". Mol Med Rep. 2011; 4(3):395-401.
Leitão A. et al.: "Identification of a 25-aminoacid sequence from the major African swine fever virus structural protein VP72 recognised by porcine cytotoxic T lymphocytes using a lipoprotein based expression system". J Virol Methods. 1998;75(1):113-9.
Leitão A., et al.: "Bacterial lipoprotein based expression vectors as tools for the characterisation of African swine fever virus (ASFV) antigens". Arch Virol. 2000;145(8):1639-57.
Lokhandwala S., et al.: "Adenovirus-vectored African swine fever virus antigen cocktails are immunogenic but not protective against intranasal challenge with Georgia 2007/1 isolate". Vet Microbiol. 2019;235:10-20.
Arias M., et al.: "Approaches and Perspectives for Development of African Swine Fever Virus Vaccines". Vaccines 2017, 5, 35.
Bacciu D., et al.: "Genomic analysis of Sardinian 26544/OG10 isolate of African swine fever virus". Virology Reports 6 (2016) 81-89.
Bao J., et al.: "Genome comparison of African swine fever virus China/2018/AnhuiXCGQ strain and related European p72 Genotype II strains". Transbound Emerg Dis. 2019;66:1167-1176.
Cadenas-Fernández E., et al.: "Adenovirus-vectored African Swine Fever Virus Antigens Cocktail Is Not Protective against Virulent Arm07 Isolate in EurasianWild Boar". Pathogens 2020, 9, 171; doi:10.3390/pathogens9030171.
Chapman D.A., et al.: "Comparison of the genome sequences of nonpathogenic and pathogenic African swine fever virus isolates". Journal of General Virology (2008), 89, 397-408.
Correia S., et al.: "Identification and utility of innate immune system evasion mechanisms of ASFV". Virus Research 173 (2013) 87-100.
Gallardo C., et al.: "Experimental Infection of Domestic Pigs with African Swine Fever Virus Lithuania 2014 Genotype II Field Isolate". Transboundary and Emerging Diseases. 64 (2017) 300-304.
Gaudreault N., et al.: "Subunit Vaccine Approaches for African Swine Fever Virus". Vaccines 2019, 7, 56; doi:10.3390/vaccines7020056.
Gilliaux G., et al.: "Newly emerged African swine fever virus strain Belgium/Etalle/wb/2018: Complete genomic sequence and comparative analysis with reference p72 genotype II strains". Transbound Emerg Dis. 2019;66:2566-2591.
Jaing C., et al.: "Gene expression analysis of whole blood RNA from pigs infected with low and high pathogenic African swine fever viruses" SCieNtIfIc REPOrTs | 7: 10115 | DOI:10.1038/s41598-017-10186-4.
Jia L., et al.: "Nanopore sequencing of African swine fever virus". Sci China Life Sci Jan. 2020 vol. 63 No. 1.
Kollnberger S.D., et al.: "Identification of the principal serological immunodeterminants of African swine fever virus by screening a virus cDNA library with antibody". Journal of General Virology (2002), 83, 1331-1342.
Kovalenko G., et al.: "Complete Genome Sequence of a Virulent African Swine Fever Virus from a Domestic Pig in Ukraine". Microbiology Resource Announcement vol. 8 Issue 42 e00883-19.
Lokhandwala S., et al.: "Adenovirus-vectored novel African Swine Fever Virus antigens elicit robust immune responses in swine". PLoS One 12(5): e0177007.
Malogolovkin A., et al.: "Genetic and antigenic diversity of African swine fever virus". Virus Research 271 (2019) 197673.
Olasz F., et al.: "A Simple Method for Sample Preparation to Facilitate Efficient Whole-Genome Sequencing of African Swine Fever Virus". Viruses 2019, 11, 1129.
Portugal R., et al.: "Related strains of African swine fever virus with different virulence: genome comparison and analysis". Journal of General Virology (2015), 96, 408-419.
Pérez-Núñez D., et al.: "Evaluation of a viral DNA-protein immunization strategy against African swine fever in domestic pigs". Veterinary Immunology and Immunopathology 208 (2019) 34-43.
Reis A. L., et al.: "Systematic analysis of longitudinal serological responses of pigs infected experimentally with African swine fever virus". Journal of General Virology (2007), 88, 2426-2434.
Sang H., et al.: "Progress Toward Development of Effective and Safe African Swine Fever Virus Vaccines". Front. Vet. Sci. 7:84.
Torresi C., et al.: "The evolution of African swine fever virus in Sardinia (1978-2014) as revealed by whole-genome sequencing and comparative analysis". Transbound Emerg Dis 2020;00:1-10.
Wen X., et al.: "Genome sequences derived from pig and dried blood pig feed samples provide important insights into the transmission of African swine fever virus in China in 2018". Emerging Microbes & Infections 2019, vol. 8 303-306.
Xiong D., et al.: "Rapid phylogenetic analysis of African swine fever virus from metagenomic sequences". bioRxiv preprint doi: https://doi.org/10.1101/756726.

* cited by examiner

Figure 5

% survival vs Days after Georgia2007/1 challenge

- ME-I + ME-II: 60% (3/5)
- Control: 20% (1/5)

IMMUNOGENIC COMPOSITIONS AND VACCINES COMPRISING AFRICAN SWINE FEVER VIRUS PEPTIDES AND PROTEINS AND USES THEREOF

CROSS-REFERENCE TO RELATED APPLICATIONS

This application claims priority to European patent application EP 19382216.0 filed on Mar. 27, 2019, the disclosure of which is hereby incorporated by reference.

SEQUENCE LISTING

The Sequence Listing associated with this application is provided in text format in lieu of a paper copy, and is hereby incorporated by reference into the specification. The name of the text file containing the Sequence Listing is SequenceListing_3357.txt. The text file is 1,145 KB; it was created on 17 Feb. 2020; and it is being submitted electronically via EFS-Web, concurrent with the filing of the specification.

This application contains a sequence listing in accordance with 37 C.F.R. 1.821-1.825. The sequence listing accompanying this application is hereby incorporated by reference in its entirety.

BACKGROUND OF THE INVENTION

A. Field of the Invention

The present invention relates to the field of veterinary vaccines, and specifically to African swine fever virus peptides and/or polypeptides, preferably full-length proteins, as well as immunogenic fragments thereof, corresponding encoding African swine fever virus oligonucleotides and/or polynucleotides as well as immunogenic fragments thereof, immunogenic compositions, vaccines and uses thereof.

B. Background and Description of the Related Art

The continuous spread of African swine fever (ASF) through Continental Europe after its introduction in Georgia in 2007, and its subsequent expansion in Asia from 2018, evidence this disease as a major threat to swine industry worldwide. ASF is a pig hemorrhagic disease of obligatory declaration to the World Organization for Animal Health (OIE) and causes enormous economic losses to the affected countries. The causative agent, African swine fever virus (ASFV), is a large, enveloped, icosahedral virus with a dsDNA genome of about 180 kbp in length. There is currently no commercial vaccine against ASFV. Early and efficient diagnosis followed by slaughtering of infected and in contact animals are the only control methods today recommended by the OIE, measures unfortunately not affordable by less favored regions.

ASF vaccine development is largely hindered by lack of knowledge about critical aspects of ASFV infection and protective immunity. In this regard, $CD8^+$ T lymphocytes have been widely shown to play a critical role in protective response against ASFV. However, the identity of the ASFV antigens capable of inducing protective $CD8^+$ T-cell responses remains largely unknown. Identification of such protective antigens could lead to rationale vaccine design as well as better understanding the mechanisms underlying ASFV immunity.

The feasibility of affording protection against the Georgia2007/1 isolate has been confirmed with the use of live attenuated viruses (Monteagudo et al., 2017; O'Donnell et al., 2015), evidencing the presence of protective Georgia2007/1 antigens. Notwithstanding, while DNA vaccination has proven successful to determine antigens or epitopes with protective potential against the E75 ASFV (Argilaguet et al., 2012; Lacasta et al., 2014), these results could not be reproduced when working with the highly virulent Georgian isolate. Other DNA-based vaccine formulations have rendered ASFV-specific response, but again failed to confer protection against Georgia2007/1 isolate/strain (Jancovich et al., 2018; Lopera-Madrid et al., 2017).

Further prior art is as follows:

Farlow J et al. (Virology Journal 2018, 15(1): 190) describe the intra-epidemic genome variation in highly pathogenic African swine fever virus (ASFV) from the country of Georgia.

Uniprot Database discloses ASFV Georgia 2007/1 full CDS protein A118R under accession number A0A2X0RVA9.

De Villiers E P et al. (Virology 2010, 400: 128-136) describe the phylogenetic analysis of 11 complete African swine fever virus genome sequences.

Netherton C L et al. (Front Immunol 2019, 10: 1318) describe the identification and immunogenicity of African swine fever virus antigens.

Sánchez E G et al. (Virus Research 2019, 265: 150-155) describe the development of vaccines against African swine fever virus.

WO 2017/096341 discloses adenovirus-vectored multivalent vaccines.

There remains an unmet need for safe ASF vaccines that in particular confer protection against the Georgia2007/1 ASFV isolate/strain.

SUMMARY OF THE INVENTION

In order to overcome the deficiencies in the prior art, the invention provides immunogenic compositions comprising (a) one, two or more African swine fever virus peptides and/or polypeptides, preferably full-length proteins, and/or immunogenic fragments thereof; and/or (b) one, two or more African swine fever virus oligonucleotides and/or polynucleotides and/or immunogenic fragments thereof encoding African swine fever virus peptides and/or polypeptides, preferably full-length proteins, and/or immunogenic fragments thereof; and/or (c) a viral or bacterial vector, preferably a recombinant and/or non-naturally occurring viral or bacterial vector, comprising one, two or more African swine fever virus oligonucleotides and/or polynucleotides and/or immunogenic fragments thereof encoding African swine fever virus peptides and/or polypeptides, preferably full-length proteins, and/or immunogenic fragments thereof; and (d) optionally, one or more pharmaceutical- or veterinary-acceptable carriers or excipients, preferably said one or more carriers or excipients being suitable for oral, intradermal, intramuscular or intranasal application.

The invention further concerns vaccines or pharmaceutical compositions comprising (a) one, two or more African swine fever virus peptides and/or polypeptides, preferably full-length proteins, and/or immunogenic fragments thereof; and/or (b) one, two or more African swine fever virus oligonucleotides and/or polynucleotides and/or immunogenic fragments thereof encoding African swine fever virus peptides and/or polypeptides, preferably full-length proteins, and/or immunogenic fragments thereof; and/or (c) a viral or bacterial vector, preferably a recombinant and/or non-naturally occurring viral or bacterial vector, comprising one, two or more African swine fever virus oligonucleotides and/or polynucleotides and/or immunogenic fragments thereof encoding African swine fever virus peptides and/or polypeptides, preferably full-length proteins, and/or immunogenic fragments thereof; and (d) one or more pharmaceutical- or veterinary-acceptable carriers or excipients, preferably said one or more carriers or excipients being suitable for oral, intradermal, intramuscular or intranasal application;

(e) optionally, said vaccine or pharmaceutical composition further comprising an adjuvant.

The invention further concerns the immunogenic compositions or the vaccines or pharmaceutical compositions as herein described and/or claimed for use in a method of reducing or preventing the clinical signs or disease in porcines, preferably a pig, caused by an infection with at least one, preferably pathogenic, African swine fever virus or for use in a method of treating and/or preventing an infection with at least one, preferably pathogenic, African swine fever virus in porcines, preferably a pig, wherein preferably said clinical signs or disease caused by an infection with at least one, preferably pathogenic, African swine fever virus or said infection with at least one, preferably pathogenic, African swine fever virus are selected from the group consisting of: African swine fever, acute African swine fever, chronic African swine fever, mortality, death, sudden death, fever, high fever, anorexia, lethargy, weakness, loss of appetite, recumbence, erythema, cyanotic skin blotching, diarrhea, constipation, abdominal pain, respiratory signs, coughing, vomiting, dyspnea, nasal and conjunctival discharges, hemorrhages, epistaxis, abortion, leukopenia, thrombocytopenia. A corresponding method of reducing or preventing the clinical signs or disease in porcines, preferably a pig, caused by an infection with at least one, preferably pathogenic, African swine fever virus or corresponding method of treating and/or preventing an infection with at least one, preferably pathogenic, African swine fever virus in porcines, preferably a pig, comprising administering to such porcine, preferably pig, the immunogenic compositions or the vaccines or pharmaceutical compositions as herein described and/or claimed, as well as the corresponding use of the immunogenic compositions or the vaccines or pharmaceutical compositions as herein described and/or claimed for the preparation of a medicament for reducing or preventing the clinical signs or disease in porcines, preferably a pig, caused by an infection with at least one, preferably pathogenic, African swine fever virus or for treating and/or preventing an infection with at least one, preferably pathogenic, African swine fever virus in porcines, preferably a pig, are also intended to be comprised by the present invention.

The invention further concerns the immunogenic compositions or the vaccines or pharmaceutical compositions as herein described and/or claimed for use in a method of immunizing a porcine, preferably a pig, against a clinical disease caused by at least one, preferably pathogenic, African swine fever virus in said porcine, preferably pig, said method comprising the step of administering to the porcine, preferably pig, the immunogenic composition or the vaccine or pharmaceutical composition as herein described and/or claimed, wherein said immunogenic composition or vaccine or pharmaceutical composition fails to cause clinical signs of infection but is capable of inducing an immune response that immunizes the porcine, preferably pig, against, preferably pathogenic forms of, said at least one African swine fever virus, wherein preferably said clinical disease or said clinical signs of infection are selected from the group consisting of: African swine fever, acute African swine fever, chronic African swine fever, mortality, death, sudden death, fever, high fever, anorexia, lethargy, weakness, loss of appetite, recumbence, erythema, cyanotic skin blotching, diarrhea, constipation, abdominal pain, respiratory signs, coughing, vomiting, dyspnea, nasal and conjunctival discharges, hemorrhages, epistaxis, abortion, leukopenia, thrombocytopenia. A corresponding method of immunizing a porcine, preferably a pig, against a clinical disease caused by at least one, preferably pathogenic, African swine fever virus in said porcine, preferably pig, said method comprising the step of administering to the porcine, preferably pig, the immunogenic composition or the vaccine or pharmaceutical composition as herein described and/or claimed, wherein said immunogenic composition or vaccine or pharmaceutical composition fails to cause clinical signs of infection but is capable of inducing an immune response that immunizes the porcine, preferably pig, against, preferably pathogenic forms of, said at least one African swine fever virus, as well as the corresponding use of the immunogenic compositions or the vaccines or pharmaceutical composition as herein described and/or claimed for the preparation of a medicament for immunizing a porcine, preferably a pig, against a clinical disease caused by at least one, preferably pathogenic, African swine fever virus in said porcine, preferably pig, wherein said immunogenic composition or vaccine or pharmaceutical composition fails to cause clinical signs of infection but is capable of inducing an immune response that immunizes the porcine, preferably pig, against, preferably pathogenic forms of, said at least one African swine fever virus, are also intended to be comprised by the present invention.

The invention further concerns the immunogenic compositions or the vaccines or pharmaceutical compositions as herein described and/or claimed for use in a method of prime-boost immunizing a porcine, preferably a pig, against a clinical disease caused by at least one, preferably pathogenic, African swine fever virus in said porcine, preferably pig, said method comprising the step of administering to the porcine, preferably pig, once or twice an immunogenic composition or the vaccine or pharmaceutical composition as herein described and/or claimed comprising (i) one, two or more African swine fever virus oligonucleotides and/or polynucleotides and/or immunogenic fragments thereof as sole immunogenic components or (ii) a viral or bacterial vector, preferably a recombinant and/or non-naturally occurring viral or bacterial vector, comprising one, two or more African swine fever virus oligonucleotides and/or polynucleotides and/or immunogenic fragments thereof as sole immunogenic component (priming step); and subsequently—after priming once or twice—administering to the porcine, preferably pig, a live attenuated African swine fever virus, preferably BA71ΔCD2 (boosting step); wherein said immunogenic composition or vaccine or pharmaceutical composition as well as the live attenuated African swine fever virus independently from each other fail to cause clinical signs of infection but are capable of inducing an immune response that immunizes the porcine, preferably pig, against, preferably pathogenic forms of, said at least one African swine fever virus, wherein preferably said clinical disease or said clinical signs of infection are selected from the group consisting of: African swine fever, acute African swine fever, chronic African swine fever, mortality, death, sudden death, fever, high fever, anorexia, lethargy, weakness, loss of appetite, recumbence, erythema, cyanotic skin blotching, diarrhea, constipation, abdominal pain, respiratory signs, coughing, vomiting, dyspnea, nasal and conjunctival discharges, hemorrhages, epistaxis, abortion, leukopenia, thrombocytopenia. A corresponding method of prime-boost immunizing a porcine, preferably a pig, against a clinical disease caused by at least one, preferably pathogenic, African swine fever virus in said porcine, preferably pig, said method comprising the step of administering to the porcine, preferably pig, once or twice an immunogenic composition or the vaccine or pharmaceutical composition as herein described and/or claimed comprising (i) one, two or more African swine fever virus oligonucleotides and/or polynucleotides and/or immunogenic fragments thereof as sole immunogenic components or (ii) a viral or bacterial vector, preferably a recombinant and/or non-naturally occurring viral or bacterial vector, comprising one, two or more African swine fever virus oligonucleotides and/or polynucleotides and/or immunogenic fragments thereof as sole immunogenic component (priming step); and subsequently—after priming once or twice—administering to the porcine, preferably pig, a live attenuated African swine fever virus, preferably BA71ΔCD2 (boosting step); wherein said immunogenic composition or vaccine or pharmaceutical composition as well as the live attenuated African swine fever virus independently from each other fail to cause clinical signs of infection but are capable of inducing an immune response that immunizes the porcine, preferably pig, against, preferably pathogenic forms of, said at least one African swine fever virus, as well as the corresponding use of the immunogenic compositions or the vaccines or pharmaceutical compositions as herein described and/or claimed for the preparation of a medicament for prime-boost immunizing a porcine, preferably a pig, against a clinical disease caused by at least one, preferably pathogenic, African swine fever virus in said porcine, preferably pig, are also intended to be comprised by the present invention.

The invention further concerns a kit for vaccinating a porcine, preferably a pig, against a disease associated with and/or reducing the incidence or the severity of one or more clinical signs associated with or caused by at least one, preferably pathogenic, African swine fever virus in a porcine, preferably a pig, comprising:

(a) a dispenser capable of administering a vaccine to said porcine; and
(b) the immunogenic composition or the vaccine or pharmaceutical composition as herein described and/or claimed, and
(c) optionally, an instruction leaflet;
wherein preferably said disease or said clinical signs are selected from the group consisting of: African swine fever, acute African swine fever, chronic African swine fever, mortality, death, sudden death, fever, high fever, anorexia, lethargy, weakness, loss of appetite, recumbence, erythema, cyanotic skin blotching, diarrhea, constipation, abdominal pain, respiratory signs, coughing, vomiting, dyspnea, nasal and conjunctival discharges, hemorrhages, epistaxis, abortion, leukopenia, thrombocytopenia.

The invention further concerns an African swine fever virus peptide and/or polypeptide, preferably full-length-protein, and/or immunogenic fragment thereof comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: SEQ ID NOS: 1, 2, 3, 4, 5, 6, 7, 8, 9, 10, 11, 12, 13, 14, 15, 16, 17, 19, 21, 23, 25, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 1, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 272, 274, 275, 276, 277, 278, 279, 280, 281, 282, 283, 284, 285, 287, 289, 290, 291, 292, 293, 294, 295, 297, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 420, 422, 423, 424, 425, 426, 427, 428, 429, 430, 432, 434, 435, 436, 437, 438, 439, 440, 441, 442, 443, 444, 445, 446, 447, 448, 449, 450, 451, 452, 453, 454, 455, 456, 458, 460, 461, 462, 463, 464, 465, 466, 468, 470, 471, 472, 473, 474, 475, 476, 477, 478, 479, 481, 483, 484, 485, 486, 487, 489, 491, 492, 493, 494, 495, 496, 497, 498, 499, 500, 501, 502, 503, 504, 505, 506, 507, 508, 509, 510, 511, 512, 513, 514, 515, 516, 518, 520, 521, 522, 523, 524, 526, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 568, 570, 572, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693, 694, 695, 696, 697, 698, 699, 700, 701, 702, 703, 704, 705, 706, 707, 708, 709, 710, 711, 712, 713, 714, 715, 716, 717, 719, 721, 722, 724, 726, 727, 728, 729, 730, 731, 732, 733, 734, 735, 736, 737, 738, 739, 740, 741, 742, 743, 744, 745, 746, 747, 748, 749, 750, 751, 752, 753, 754, 755, 756, 757, 758, 759, 760, 761, 762, 763, 764, 765, 766, 767, 768, 769, 770, 771, 772, 774, 776, 777, 778, 779, 780, 781, 782, 783, 784, 785, 786, 787, 788, 789, 790, 791, 792, 793, 794, 795, 796, 797, 798, 799, 800, 801, 802, 803, 804, 805, 806, 807, 808, 809, 810, 811, 812, 813, 814, 815, 816, 817, 818, 819, 820, 821, 822, 823, 824, 825, 826, 827, 828, 829, 830, 831, 832, 833, 834, 835, 836, 837, 838, 839, 840, 841, 842, 843, 844, 845, 846, 847, 848, 849, 850, 851, 852, 853, 854.

The invention further concerns an African swine fever virus peptide and/or polypeptide, preferably full-length-protein, and/or immunogenic fragment thereof comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: MGF505-7R/MGF505-8R (SEQ ID NOS: 774, 772, 724, 722, 721, 719, 717), M448R (SEQ ID NOS: 568, 566, 565, 564, 563), D1133L (SEQ ID NOS: 297, 295, 294, 293, 292, 291, 290, 289, 287, 285, 284, 283, 282, 281), CP312R (SEQ ID NOS: 274, 272, 269, 268, 267), A240L (SEQ ID NOS: 854, 853, 25), A238L (SEQ ID NOS: 23, 21, 19, 17), MGF100-1L (SEQ ID NOS: 572, 570), K145R (SEQ ID NOS: 526, 524, 523, 522, 521, 520, 518, 516, 515, 514), B475L (SEQ ID NOS: 66, 65, 64, 63, 62, 61, 60, 59, 58, 57, 56, 55, 54, 53, 52, 51, 50, 49, 48), H339R (SEQ ID NOS: 468, 466, 465, 464, 463, 462, 461, 460, 458, 456, 455, 454), I226R (SEQ ID NOS: 489, 487, 486, 485, 484, 483, 481, 479, 478), CP2475L (p37) (SEQ ID NOS: 266, 265, 264, 263, 262, 261), CP2475L (p150) (SEQ ID NOS: 260, 259, 258), G1211R (SEQ ID NOS: 432, 430, 429, 428, 427, 426, 425, 424, 423, 422, 420, 418, 417, 416), M1249L (SEQ ID NOS: 562, 561, 560, 559, 558, 557, 556, 555, 554, 553, 552, 551, 550, 549, 548, 547, 546, 545, 544, 543, 542, 541, 540, 539), MGF505-9R (SEQ ID NOS: 733, 732, 731, 730, 729, 728, 727, 726), P1192R (SEQ ID NOS: 817, 816, 815, 814, 813, 812, 811, 810, 809, 808, 807, 806, 805, 804, 803, 802, 801), MGF505-1R (SEQ ID NOS: 692, 691, 690, 689, 688, 687, 686, 685, 684), MGF505-3R (SEQ ID NOS: 703, 702, 701, 700, 699), EP424R (SEQ ID NOS: 389, 388, 387, 386, 385, 384, 383, 382, 381, 380, 379), C475L (SEQ ID NOS: 201, 200, 199, 198, 197, 196, 195, 194, 193, 192, 191, 190, 189, 188), B602L (SEQ ID NOS: 75, 74, 73, 72, 71, 70, 69, 68, 67), CP530R (SEQ ID NOS: 278, 277, 276, 275), D339L (SEQ ID NOS: 322, 321, 320), D117L (SEQ ID NOS: 862, 864), I243L (SEQ ID NOS: 494, 493, 492, 491), I73R (SEQ ID NOS: 504, 503, 502), DP238L (SEQ ID NOS: 327, 326, 325), I9R (SEQ ID NOS: 513, 512, 511, 510), preferably selected from the group consisting of: MGF505-7R/MGF505-8R (SEQ ID NOS: 774, 772, 724, 722, 721, 719, 717), M448R (SEQ ID NOS: 568, 566, 565, 564, 563), D1133L (SEQ ID NOS: 297, 295, 294, 293, 292, 291, 290, 289, 287, 285, 284, 283, 282, 281), CP312R (SEQ ID NOS: 274, 272, 269, 268, 267), A240L (SEQ ID NOS: 854, 853, 25), A238L (SEQ ID NOS: 23, 21, 19, 17), MGF100-1L (SEQ ID NOS: 572, 570); and most preferably selected from the group consisting of: MGF505-7R/MGF505-8R (SEQ ID NOS: 774, 772, 724, 722, 721, 719, 717), M448R (SEQ ID NOS: 568, 566, 565, 564, 563), D1133L (SEQ ID NOS: 297, 295, 294, 293, 292, 291, 290, 289, 287, 285, 284, 283, 282, 281), CP312R (SEQ ID NOS: 274, 272, 269, 268, 267), A240L (SEQ ID NOS: 854, 853, 25).

The invention further concerns an African swine fever virus peptide and/or polypeptide, preferably full-length-protein, and/or immunogenic fragment thereof, wherein the African swine fever virus polypeptides, preferably full length proteins, comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: A238L (SEQ ID NO: 21), A238L (SEQ ID NO: 23), A240L (SEQ ID NO: 853), A240L (SEQ ID NO: 854), B475L (SEQ ID NO: 65), B475L (SEQ ID NO: 66), CP2475 (SEQ ID NO: 256), CP2475 (SEQ ID NO: 257), CP312R (SEQ ID NO: 272), CP312R (SEQ ID NO: 274), D1133L (SEQ ID NO: 295), D1133L (SEQ ID NO: 297), EP402R (SEQ ID NO: 378), EP424R (SEQ ID NO: 388), EP424R (SEQ ID NO: 389), G1211R (SEQ ID NO: 430), G1211R (SEQ ID NO: 432), H339R (SEQ ID NO: 466), H339R (SEQ ID NO: 468), I226R (SEQ ID NO: 487), I226R (SEQ ID NO: 489), K145R (SEQ ID NO: 524), K145R (SEQ ID NO: 526), M448R (SEQ ID NO: 566), M448R (SEQ ID NO: 568), M1249L (SEQ ID NO: 561), M1249L (SEQ ID NO: 562), MGF_100-1L/MGF100-1L (SEQ ID NO: 572), MGF505-1R/MGF_505-1R (SEQ ID NO: 691), MGF505-1R/MGF_505-1R (SEQ ID NO: 692), MGF505-8R/MGF_505-8R (SEQ ID NO: 722), MGF505-7R/MGF_505-7R (SEQ ID NO: 724), MGF505-8R/MGF_505-8R (SEQ ID NO: 772), MGF505-7R/MGF_505-7R (SEQ ID NO: 774), MGF505-9R/MGF_505-9R (SEQ ID NO: 732), MGF505-9R/MGF_505-9R (SEQ ID NO: 733), P1192R (SEQ ID NO: 816), P1192R (SEQ ID NO: 817) and/or wherein the African swine fever virus peptides and/or immunogenic fragments thereof and/or African swine fever virus polypeptide/full-length protein immunogenic fragments comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: A238L (SEQ ID NO: 17), A238L (SEQ ID NO: 19), A240L (SEQ ID NO: 25), B475L (SEQ ID NO: 48), B475L (SEQ ID NO: 49), B475L (SEQ ID NO: 50), B475L (SEQ ID NO: 51), B475L (SEQ ID NO: 52), B475L (SEQ ID NO: 53), B475L (SEQ ID NO: 54), B475L (SEQ ID NO: 55), B475L (SEQ ID NO: 56), B475L (SEQ ID NO: 57), B475L (SEQ ID NO: 58), B475L (SEQ ID NO: 59), B475L (SEQ ID NO: 60), B475L (SEQ ID NO: 61), B475L (SEQ ID NO: 62), B475L (SEQ ID NO: 63), B475L (SEQ ID NO: 64), CP2475 (SEQ ID NO: 235), CP2475 (SEQ ID NO: 236), CP2475 (SEQ ID NO: 237), CP2475 (SEQ ID NO: 238), CP2475 (SEQ ID NO: 239), CP2475 (SEQ ID NO: 240), CP2475 (SEQ ID NO: 241), CP2475 (SEQ ID NO: 242), CP2475 (SEQ ID NO: 243), CP2475 (SEQ ID NO: 244), CP2475 (SEQ ID NO: 245), CP2475 (SEQ ID NO: 246), CP2475 (SEQ ID NO: 247), CP2475 (SEQ ID NO: 248), CP2475 (SEQ ID NO: 249), CP2475 (SEQ ID NO: 250), CP2475 (SEQ ID NO: 251), CP2475 (SEQ ID NO: 252), CP2475 (SEQ ID NO: 253), CP2475 (SEQ ID NO: 254), CP2475 (SEQ ID NO: 255), CP2475L (p37) (SEQ ID NO: 261), CP2475L (p37) (SEQ ID NO: 262), CP2475L (p37) (SEQ ID NO: 263), CP2475L (p37) (SEQ ID NO: 264), CP2475L (p37) (SEQ ID NO: 265), CP2475L (p37) (SEQ ID NO: 266), CP2475L (p150) (SEQ ID NO: 258), CP2475L (p150) (SEQ ID NO: 259), CP2475L (p150) (SEQ ID NO: 260), CP312R (SEQ ID NO: 267), CP312R (SEQ ID NO: 268), CP312R (SEQ ID NO: 269), D1133L (SEQ ID NO: 281), D1133L (SEQ ID NO: 282), D1133L (SEQ ID NO: 283), D1133L (SEQ ID NO: 284), D1133L (SEQ ID NO: 285), D1133L (SEQ ID NO: 287), D1133L (SEQ ID NO: 289), D1133L (SEQ ID NO: 290), D1133L (SEQ ID NO: 291), D1133L (SEQ ID NO: 292), D1133L (SEQ ID NO: 293), D1133L (SEQ ID NO: 294), EP402R (SEQ ID NO: 372), EP402R (SEQ ID NO: 373), EP402R (SEQ ID NO: 374), EP402R (SEQ ID NO: 375), EP402R (SEQ ID NO: 376), EP402R (SEQ ID NO: 377), EP424R (SEQ ID NO: 379), EP424R (SEQ ID NO: 380), EP424R (SEQ ID NO: 381), EP424R (SEQ ID NO: 382), EP424R (SEQ ID NO: 383), EP424R (SEQ ID NO: 384), EP424R (SEQ ID NO: 385), EP424R (SEQ ID NO: 386), EP424R (SEQ ID NO: 387), G1211R (SEQ ID NO: 416), G1211R (SEQ ID NO: 417), G1211R (SEQ ID NO: 418), G1211R (SEQ ID NO: 420), G1211R (SEQ ID NO: 422), G1211R (SEQ ID NO: 423), G1211R (SEQ ID NO: 424), G1211R (SEQ ID NO: 425), G1211R (SEQ ID NO: 426), G1211R (SEQ ID NO: 427), G1211R (SEQ ID NO: 428), G1211R (SEQ ID NO: 429), H339R (SEQ ID NO: 454), H339R (SEQ ID NO: 455), H339R (SEQ ID NO: 456), H339R (SEQ ID NO: 458), H339R (SEQ ID NO: 460), H339R (SEQ ID NO: 461), H339R (SEQ ID NO: 462), H339R (SEQ ID NO: 463), H339R (SEQ ID NO: 464), H339R (SEQ ID NO: 465), I226R (SEQ ID NO: 478), I226R (SEQ ID NO: 479), I226R (SEQ ID NO: 481), I226R (SEQ ID NO: 483), I226R (SEQ ID NO: 484), I226R (SEQ ID NO: 485), I226R (SEQ ID NO: 486), K145R (SEQ ID NO: 514), K145R (SEQ ID NO: 515), K145R (SEQ ID NO: 516), K145R (SEQ ID NO: 518), K145R (SEQ ID NO: 520), K145R (SEQ ID NO: 521), K145R (SEQ ID NO: 522), K145R (SEQ ID NO: 523), M448R (SEQ ID NO: 563), M448R (SEQ ID NO: 564), M448R (SEQ ID NO: 565), M1249L (SEQ ID NO: 539), M1249L (SEQ ID NO: 540), M1249L (SEQ ID NO: 541), M1249L (SEQ ID NO: 542), M1249L (SEQ ID NO: 543), M1249L (SEQ ID NO: 544), M1249L (SEQ ID NO: 545), M1249L (SEQ ID NO: 546), M1249L (SEQ ID NO: 547), M1249L (SEQ ID NO: 548), M1249L (SEQ ID NO: 549), M1249L (SEQ ID NO: 550), M1249L (SEQ ID NO: 551), M1249L (SEQ ID NO: 552), M1249L (SEQ ID NO: 553), M1249L (SEQ ID NO: 554), M1249L (SEQ ID NO: 555), M1249L (SEQ ID NO: 556), M1249L (SEQ ID NO: 557), M1249L (SEQ ID NO: 558), M1249L (SEQ ID NO: 559), M1249L (SEQ ID NO: 560), MGF_100-1L/MGF100-1L (SEQ ID NO: 570), MGF505-1R/MGF_505-1R (SEQ ID NO: 684), MGF505-1R/MGF_505-1R (SEQ ID NO: 685), MGF505-1R/MGF_505-1R (SEQ ID NO: 686), MGF505-1R/MGF_505-1R (SEQ ID NO: 687), MGF505-1R/MGF_505-1R (SEQ ID NO: 688), MGF505-1R/MGF_505-1R (SEQ ID NO: 689), MGF505-1R/MGF_505-1R (SEQ ID NO: 690), MGF505-8R/MGF_505-8R (SEQ ID NO: 717), MGF505-7R/MGF_505-7R (SEQ ID NO: 719), MGF505-7R/MGF_505-7R (SEQ ID NO: 721), MGF505-9R/MGF_505-9R (SEQ ID NO: 726), MGF505-9R/MGF_505-9R (SEQ ID NO: 727), MGF505-9R/MGF_505-9R (SEQ ID NO: 728), MGF505-9R/MGF_505-9R (SEQ ID NO: 729), MGF505-9R/MGF_505-9R (SEQ ID NO: 730), MGF505-9R/MGF_505-9R (SEQ ID NO: 731), P1192R (SEQ ID NO: 801), P1192R (SEQ ID NO: 802), P1192R (SEQ ID NO: 803), P1192R (SEQ ID NO: 804), P1192R (SEQ ID NO: 805), P1192R (SEQ ID NO: 806), P1192R (SEQ ID NO: 807), P1192R (SEQ ID NO: 808), P1192R (SEQ ID NO: 809), P1192R (SEQ ID NO: 810), P1192R (SEQ ID NO: 811), P1192R (SEQ ID NO: 812), P1192R (SEQ ID NO: 813), P1192R (SEQ ID NO: 814), P1192R (SEQ ID NO: 815).

The invention further concerns an African swine fever virus peptide and/or polypeptide, preferably full-length-protein, and/or immunogenic fragment thereof, wherein the African swine fever virus polypeptides, preferably full-length proteins, comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: MGF505-7R/MGF505-8R (SEQ ID NOS: 774, 772, 724, 722), M448R (SEQ ID NOS: 568, 566), D1133L (SEQ ID NOS: 297, 295), CP312R (SEQ ID NOS: 274, 272), A240L (SEQ ID NOS: 854, 853), A238L (SEQ ID NOS: 23, 21), MGF100-1L (SEQ ID NO: 572), K145R (SEQ ID NOS: 526, 524), B475L (SEQ ID NOS: 66, 65), H339R (SEQ ID NOS: 468, 466), I226R (SEQ ID NOS: 489, 487), CP2475 (SEQ ID NO: 257), CP2475 (SEQ ID NO: 256), G1211R (SEQ ID NOS: 432, 430), M1249L (SEQ ID NOS: 562, 561), MGF505-9R (SEQ ID NOS: 733, 732), P1192R (SEQ ID NOS: 817, 816), MGF505-1R (SEQ ID NOS: 692, 691), MGF505-3R (SEQ ID NOS: 703, 702), EP424R (SEQ ID NOS: 389, 388), C475L (SEQ ID NOS: 201, 200), B602L (SEQ ID NOS: 75, 74), CP530R (SEQ ID NOS: 278, 277), D339L (SEQ ID NOS: 322, 321), D117L (SEQ ID NOS: 862, 864), I243L (SEQ ID NOS: 494, 493), I73R (SEQ ID NOS: 504, 503), DP238L (SEQ ID NOS: 327, 326), I9R (SEQ ID NOS: 513, 512) and/or wherein the African swine fever virus peptides and/or immunogenic fragments thereof and/or African swine fever virus polypeptide/full-length protein immunogenic fragments comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: MGF505-7R/MGF505-8R (SEQ ID NOS: 721, 719, 717), M448R (SEQ ID NOS: 565, 564, 563), D1133L (SEQ ID NOS: 294, 293, 292, 291, 290, 289, 287, 285, 284, 283, 282, 281), CP312R (SEQ ID NOS: 269, 268, 267), A240L (SEQ ID NO: 25), A238L (SEQ ID NOS: 19, 17), MGF100-1L (SEQ ID NO: 570), K145R (SEQ ID NOS: 523, 522, 521, 520, 518, 516, 515, 514), B475L (SEQ ID NOS: 64, 63, 62, 61, 60, 59, 58, 57, 56, 55, 54, 53, 52, 51, 50, 49, 48), H339R (SEQ ID NOS: 465, 464, 463, 462, 461, 460, 458, 456, 455, 454), I226R (SEQ ID NOS: 486, 485, 484, 483, 481, 479, 478), CP2475L (p37) (SEQ ID NOS: 266, 265, 264, 263, 262, 261), CP2475L (p150) (SEQ ID NOS: 260, 259, 258), G1211R (SEQ ID NOS: 429, 428, 427, 426, 425, 424, 423, 422, 420, 418, 417, 416), M1249L (SEQ ID NOS: 560, 559, 558, 557, 556, 555, 554, 553, 552, 551, 550, 549, 548, 547, 546, 545, 544, 543, 542, 541, 540, 539), MGF505-9R (SEQ ID NOS: 731, 730, 729, 728, 727, 726), P1192R (SEQ ID NOS: 815, 814, 813, 812, 811, 810, 809, 808, 807, 806, 805, 804, 803, 802, 801), MGF505-1R (SEQ ID NOS: 690, 689, 688, 687, 686, 685, 684), MGF505-3R (SEQ ID NOS: 701, 700, 699), EP424R (SEQ ID NOS: 387, 386, 385, 384, 383, 382, 381, 380, 379), C475L (SEQ ID NOS: 199, 198, 197, 196, 195, 194, 193, 192, 191, 190, 189, 188), B602L (SEQ ID NOS: 73, 72, 71, 70, 69, 68, 67), CP530R (SEQ ID NOS: 277, 276, 275), D339L (SEQ ID NO: 320), I243L (SEQ ID NOS: 492, 491), I73R (SEQ ID NO: 502), DP238L (SEQ ID NO: 325), I9R (SEQ ID NOS: 511, 510).

The invention further concerns an African swine fever virus oligonucleotide and/or polynucleotide and/or immunogenic fragment thereof encoding the African swine fever virus peptide and/or polypeptide, preferably full-length-protein, and/or immunogenic fragment thereof as herein described and/or claimed.

The invention further concerns an African swine fever virus oligonucleotide and/or polynucleotide and/or immunogenic fragment thereof encoding African swine fever virus peptides and/or polypeptides, preferably full-length proteins, and/or immunogenic fragments thereof; comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: SEQ ID NOS: 18, 20, 22, 24, 26, 27, 270, 271, 273, 286, 288, 296, 298, 419, 421, 431, 433, 457, 459, 467, 469, 480, 482, 488, 490, 517, 519, 525, 527, 567, 569, 571, 573, 718, 720, 723, 725, 773, 775.

The invention further concerns an African swine fever virus oligonucleotide and/or polynucleotide and/or immunogenic fragment thereof encoding African swine fever virus peptides and/or polypeptides, preferably full-length proteins, and/or immunogenic fragments thereof; comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF505-7R/MGF505-8R (SEQ ID NOS: 857, 775, 773, 725, 723, 720, 718), M448R (SEQ ID NOS: 858, 569, 567), D1133L (SEQ ID NOS: 859, 298, 296, 288, 286), CP312R (SEQ ID NOS: 861, 273, 901, 900, 271, 270), A240L (SEQ ID NOS: 860, 27, 26), A238L (SEQ ID NOS: 24, 22, 20, 18), MGF100-1L (SEQ ID NOS: 573, 571), K145R (SEQ ID NOS: 527, 525, 519, 517), B475L (SEQ ID NOS: 866, 867), H339R (SEQ ID NOS: 469, 467, 459, 457), I226R (SEQ ID NOS: 490, 488, 482, 480), CP2475L (p37) (SEQ ID NOS: 868, 869), CP2475L (p150) (SEQ ID NOS: 870, 871), G1211R (SEQ ID NOS: 433, 431, 421, 419), M1249L (SEQ ID NOS: 872, 873), MGF505-9R (SEQ ID NOS: 874, 875), P1192R (SEQ ID NOS: 876, 877), MGF505-1R (SEQ ID NOS: 878, 879), MGF505-3R (SEQ ID NOS: 880, 881), EP424R (SEQ ID NOS: 882, 883), C475L (SEQ ID NOS: 884, 885), B602L (SEQ ID NOS: 886, 887), CP530R (SEQ ID NOS: 888, 889), D339L (SEQ ID NOS: 890, 891), D117L (SEQ ID NOS: 863, 865), I243L (SEQ ID NOS: 892, 893), I73R (SEQ ID NOS: 894, 895), DP238L (SEQ ID NOS: 896, 897), I9R (SEQ ID NOS: 898, 899); preferably selected from the group consisting of: MGF505-7R/MGF505-8R (SEQ ID NOS: 857, 775, 773, 725, 723, 720, 718), M448R (SEQ ID NOS: 858, 569, 567), D1133L (SEQ ID NOS: 859, 298, 296, 288, 286), CP312R (SEQ ID NOS: 861, 273, 901, 900, 271, 270), A240L (SEQ ID NOS: 860, 27, 26), A238L (SEQ ID NOS: 24, 22, 20, 18), MGF100-1L (SEQ ID NOS: 573, 571); and most preferably selected from the group consisting of: MGF505-7R/MGF505-8R (SEQ ID NOS: 857, 775, 773, 725, 723, 720, 718), M448R (SEQ ID NOS: 858, 569, 567), D1133L (SEQ ID NOS: 859, 298, 296, 288, 286), CP312R (SEQ ID NOS: 861, 273, 901, 900, 271, 270), A240L (SEQ ID NOS: 860, 27, 26).

The invention further concerns a vector comprising one, two, three or more African swine fever virus oligonucleotides and/or polynucleotides and/or immunogenic fragments thereof as herein described and/or claimed. Preferably such vector comprises three African swine fever virus oligonucleotides and/or polynucleotides and/or immunogenic fragments thereof, preferably selected from EP402R, CP312R and A240L (multiepitope-I, ME-I), more preferably comprises, most preferably consists of, the nucleic acid sequence selected from the group consisting of SEQ ID NO: 855; or comprises thirteen African swine fever virus oligonucleotides and/or polynucleotides and/or immunogenic fragments thereof, preferably selected from D1133L, G1211R, M1249L, MGF505-9R, P1192R, CP2475L (p150), B475L, EP424R, H339R, I226R, K145R, MGF505-1R and CP2475L (p37) (multiepitope-II, ME-II), more preferably comprises, most preferably consists of, the nucleic acid sequence selected from the group consisting of SEQ ID NO: 856.

The invention further concerns a host cell, preferably a mammalian host cell, comprising the vector as herein described and/or claimed.

Thus, the solution to the above technical problem is achieved by the description and the embodiments, characterized in the claims, and the invention in its different aspects is implemented according to the claims.

BRIEF DESCRIPTION OF THE DRAWINGS

The following drawings form part of the present specification and are included to further demonstrate certain aspects of the present invention. The invention may be better understood by reference to one or more of these drawings in combination with the detailed description of specific embodiments presented herein.

FIG. 5 depicts the percentage of surviving pigs after the Georgia2007/1 lethal challenge within the group primed with the multiepitopes (solid line) and the control group (dashed line).

DETAILED DESCRIPTION OF THE INVENTION

Figure 1:
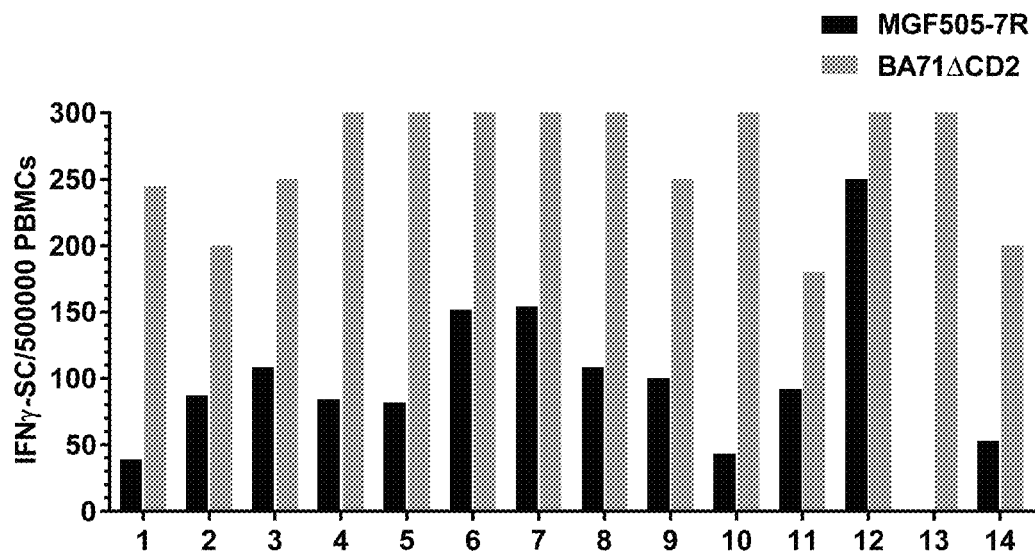
FIG. 1 depicts the following: in black, IFNγ response assessed by ELISpot assay using fibroblasts transfected with the pCMV-Ub-MGF505-7R plasmid as APCs, and PBMCs from ASF-convalescent animals as effector cells. The number of spots when stimulating with fibroblasts transfected with the pCMV-Ub empty plasmid, which never exceeded 10, were subtracted from the represented values. In grey, the levels of ASFV-specific IFNγ-SC are shown.

The present invention solves the problems inherent in the prior art and provides a distinct advance in the state of the art.

Generally, the present invention concerns immunogenic compositions comprising
(a) one, two or more African swine fever virus peptides and/or polypeptides, preferably full-length proteins, and/or immunogenic fragments thereof; and/or
(b) one, two or more African swine fever virus oligonucleotides and/or polynucleotides and/or immunogenic fragments thereof encoding African swine fever virus peptides and/or polypeptides, preferably full-length proteins, and/or immunogenic fragments thereof; and/or
(c) a viral or bacterial vector, preferably a recombinant and/or non-naturally occurring viral or bacterial vector, comprising one, two or more African swine fever virus oligonucleotides and/or polynucleotides and/or immunogenic fragments thereof encoding African swine fever virus peptides and/or polypeptides, preferably full-length proteins, and/or immunogenic fragments thereof; and
(d) optionally, one or more pharmaceutical- or veterinary-acceptable carriers or excipients, preferably said one or more carriers or excipients being suitable for oral, intradermal, intramuscular or intranasal application;
or vaccines or pharmaceutical compositions comprising
(a) one, two or more African swine fever virus peptides and/or polypeptides, preferably full-length proteins, and/or immunogenic fragments thereof; and/or (b) one, two or more African swine fever virus oligonucleotides and/or polynucleotides and/or immunogenic fragments thereof encoding African swine fever virus peptides and/or polypeptides, preferably full-length proteins, and/or immunogenic fragments thereof; and/or (c) a viral or bacterial vector, preferably a recombinant and/or non-naturally occurring viral or bacterial vector, comprising one, two or more African swine fever virus oligonucleotides and/or polynucleotides and/or immunogenic fragments thereof encoding African swine fever virus peptides and/or polypeptides, preferably full-length proteins, and/or immunogenic fragments thereof; and (d) one or more pharmaceutical- or veterinary-acceptable carriers or excipients, preferably said one or more carriers or excipients being suitable for oral, intradermal, intramuscular or intranasal application;

(e) optionally, said vaccine or pharmaceutical composition further comprising an adjuvant.

In a specific aspect, the immunogenic compositions or the vaccines or pharmaceutical compositions as described and/or claimed herein are provided, wherein the African swine fever virus is selected from the group consisting of: BA71, BA71ΔCD2 and/or Georgia2007/1 strain(s).

In another specific aspect, the immunogenic compositions or the vaccines or pharmaceutical compositions as described and/or claimed herein are provided, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: SEQ ID NOS: 1, 2, 3, 4, 5, 6, 7, 8, 9, 10, 11, 12, 13, 14, 15, 16, 17, 19, 21, 23, 25, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 1, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 272, 274, 275, 276, 277, 278, 279, 280, 281, 282, 283, 284, 285, 287, 289, 290, 291, 292, 293, 294, 295, 297, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 420, 422, 423, 424, 425, 426, 427, 428, 429, 430, 432, 434, 435, 436, 437, 438, 439, 440, 441, 442, 443, 444, 445, 446, 447, 448, 449, 450, 451, 452, 453, 454, 455, 456, 458, 460, 461, 462, 463, 464, 465, 466, 468, 470, 471, 472, 473, 474, 475, 476, 477, 478, 479, 481, 483, 484, 485, 486, 487, 489, 491, 492, 493, 494, 495, 496, 497, 498, 499, 500, 501, 502, 503, 504, 505, 506, 507, 508, 509, 510, 511, 512, 513, 514, 515, 516, 518, 520, 521, 522, 523, 524, 526, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 568, 570, 572, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693, 694, 695, 696, 697, 698, 699, 700, 701, 702, 703, 704, 705, 706, 707, 708, 709, 710, 711, 712, 713, 714, 715, 716, 717, 719, 721, 722, 724, 726, 727, 728, 729, 730, 731, 732, 733, 734, 735, 736, 737, 738, 739, 740, 741, 742, 743, 744, 745, 746, 747, 748, 749, 750, 751, 752, 753, 754, 755, 756, 757, 758, 759, 760, 761, 762, 763, 764, 765, 766, 767, 768, 769, 770, 771, 772, 774, 776, 777, 778, 779, 780, 781, 782, 783, 784, 785, 786, 787, 788, 789, 790, 791, 792, 793, 794, 795, 796, 797, 798, 799, 800, 801, 802, 803, 804, 805, 806, 807, 808, 809, 810, 811, 812, 813, 814, 815, 816, 817, 818, 819, 820, 821, 822, 823, 824, 825, 826, 827, 828, 829, 830, 831, 832, 833, 834, 835, 836, 837, 838, 839, 840, 841, 842, 843, 844, 845, 846, 847, 848, 849, 850, 851, 852, 853, 854.

In yet another specific aspect, the immunogenic compositions or the vaccines or pharmaceutical compositions as described and/or claimed herein are provided, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: MGF505-7R/MGF505-8R (SEQ ID NOS: 774, 772, 724, 722, 721, 719, 717), M448R (SEQ ID NOS: 568, 566, 565, 564, 563), D1133L (SEQ ID NOS: 297, 295, 294, 293, 292, 291, 290, 289, 287, 285, 284, 283, 282, 281), CP312R (SEQ ID NOS: 274, 272, 269, 268, 267), A240L (SEQ ID NOS: 854, 853, 25), A238L (SEQ ID NOS: 23, 21, 19, 17), MGF100-1L (SEQ ID NOS: 572, 570), K145R (SEQ ID NOS: 526, 524, 523, 522, 521, 520, 518, 516, 515, 514), B475L (SEQ ID NOS: 66, 65, 64, 63, 62, 61, 60, 59, 58, 57, 56, 55, 54, 53, 52, 51, 50, 49, 48), H339R (SEQ ID NOS: 468, 466, 465, 464, 463, 462, 461, 460, 458, 456, 455, 454), I226R (SEQ ID NOS: 489, 487, 486, 485, 484, 483, 481, 479, 478), CP2475L (p37) (SEQ ID NOS: 266, 265, 264, 263, 262, 261), CP2475L (p150) (SEQ ID NOS: 260, 259, 258), G1211R (SEQ ID NOS: 432, 430, 429, 428, 427, 426, 425, 424, 423, 422, 420, 418, 417, 416), M1249L (SEQ ID NOS: 562, 561, 560, 559, 558, 557, 556, 555, 554, 553, 552, 551, 550, 549, 548, 547, 546, 545, 544, 543, 542, 541, 540, 539), MGF505-9R (SEQ ID NOS: 733, 732, 731, 730, 729, 728, 727, 726), P1192R (SEQ ID NOS: 817, 816, 815, 814, 813, 812, 811, 810, 809, 808, 807, 806, 805, 804, 803, 802, 801), MGF505-1R (SEQ ID NOS: 692, 691, 690, 689, 688, 687, 686, 685, 684), MGF505-3R (SEQ ID NOS: 703, 702, 701, 700, 699), EP424R (SEQ ID NOS: 389, 388, 387, 386, 385, 384, 383, 382, 381, 380, 379), C475L (SEQ ID NOS: 201, 200, 199, 198, 197, 196, 195, 194, 193, 192, 191, 190, 189, 188), B602L (SEQ ID NOS: 75, 74, 73, 72, 71, 70, 69, 68, 67), CP530R (SEQ ID NOS: 278, 277, 276, 275), D339L (SEQ ID NOS: 322, 321, 320), D117L (SEQ ID NOS: 862, 864), I243L (SEQ ID NOS: 494, 493, 492, 491), I73R (SEQ ID NOS: 504, 503, 502), DP238L (SEQ ID NOS: 327, 326, 325), I9R (SEQ ID NOS: 513, 512, 511, 510), preferably selected from the group consisting of: MGF505-7R/MGF505-8R (SEQ ID NOS: 774, 772, 724, 722, 721, 719, 717), M448R (SEQ ID NOS: 568, 566, 565, 564, 563), D1133L (SEQ ID NOS: 297, 295, 294, 293, 292, 291, 290, 289, 287, 285, 284, 283, 282, 281), CP312R (SEQ ID NOS: 274, 272, 269, 268, 267), A240L (SEQ ID NOS: 854, 853, 25), A238L (SEQ ID NOS: 23, 21, 19, 17), MGF100-1L (SEQ ID NOS: 572, 570); and most preferably selected from the group consisting of: MGF505-7R/MGF505-8R (SEQ ID NOS: 774, 772, 724, 722, 721, 719, 717), M448R (SEQ ID NOS: 568, 566, 565, 564, 563), D1133L (SEQ ID NOS: 297, 295, 294, 293, 292, 291, 290, 289, 287, 285, 284, 283, 282, 281), CP312R (SEQ ID NOS: 274, 272, 269, 268, 267), A240L (SEQ ID NOS: 854, 853, 25).

In yet another specific aspect, the immunogenic composition or the vaccine or pharmaceutical composition as described and/or claimed herein are provided, wherein according to (b) the one, two or more African swine fever virus oligonucleotides and/or polynucleotides and/or immunogenic fragments thereof encode the one, two or more African swine fever virus peptides and/or polypeptides, preferably full-length proteins, and/or immunogenic fragments thereof as herein disclosed and/or claimed.

In yet another specific aspect, the immunogenic composition or the vaccine or pharmaceutical composition as described and/or claimed herein are provided, wherein according to (b) the one, two or more African swine fever virus oligonucleotides and/or polynucleotides and/or immunogenic fragments thereof encode the one, two or more African swine fever virus peptides and/or polypeptides, preferably full-length proteins, and/or immunogenic fragments thereof comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: MGF505-7R/MGF505-8R (SEQ ID NOS: 774, 772, 724, 722, 721, 719, 717), M448R (SEQ ID NOS: 568, 566, 565, 564, 563), D1133L (SEQ ID NOS: 297, 295, 294, 293, 292, 291, 290, 289, 287, 285, 284, 283, 282, 281), CP312R (SEQ ID NOS: 274, 272, 269, 268, 267), A240L (SEQ ID NOS: 854, 853, 25), A238L (SEQ ID NOS: 23, 21, 19, 17), MGF100-1L (SEQ ID NOS: 572, 570), K145R (SEQ ID NOS: 526, 524, 523, 522, 521, 520, 518, 516, 515, 514), B475L (SEQ ID NOS: 66, 65, 64, 63, 62, 61, 60, 59, 58, 57, 56, 55, 54, 53, 52, 51, 50, 49, 48), H339R (SEQ ID NOS: 468, 466, 465, 464, 463, 462, 461, 460, 458, 456, 455, 454), I226R (SEQ ID NOS: 489, 487, 486, 485, 484, 483, 481, 479, 478), CP2475L (p37) (SEQ ID NOS: 266, 265, 264, 263, 262, 261), CP2475L (p150) (SEQ ID NOS: 260, 259, 258), G1211R (SEQ ID NOS: 432, 430, 429, 428, 427, 426, 425, 424, 423, 422, 420, 418, 417, 416), M1249L (SEQ ID NOS: 562, 561, 560, 559, 558, 557, 556, 555, 554, 553, 552, 551, 550, 549, 548, 547, 546, 545, 544, 543, 542, 541, 540, 539), MGF505-9R (SEQ ID NOS: 733, 732, 731, 730, 729, 728, 727, 726), P1192R (SEQ ID NOS: 817, 816, 815, 814, 813, 812, 811, 810, 809, 808, 807, 806, 805, 804, 803, 802, 801), MGF505-1R (SEQ ID NOS: 692, 691, 690, 689, 688, 687, 686, 685, 684), MGF505-3R (SEQ ID NOS: 703, 702, 701, 700, 699), EP424R (SEQ ID NOS: 389, 388, 387, 386, 385, 384, 383, 382, 381, 380, 379), C475L (SEQ ID NOS: 201, 200, 199, 198, 197, 196, 195, 194, 193, 192, 191, 190, 189, 188), B602L (SEQ ID NOS: 75, 74, 73, 72, 71, 70, 69, 68, 67), CP530R (SEQ ID NOS: 278, 277, 276, 275), D339L (SEQ ID NOS: 322, 321, 320), D117L (SEQ ID NOS: 862, 864), I243L (SEQ ID NOS: 494, 493, 492, 491), I73R (SEQ ID NOS: 504, 503, 502), DP238L (SEQ ID NOS: 327, 326, 325), I9R (SEQ ID NOS: 513, 512, 511, 510), preferably selected from the group consisting of: MGF505-7R/MGF505-8R (SEQ ID NOS: 774, 772, 724, 722, 721, 719, 717), M448R (SEQ ID NOS: 568, 566, 565, 564, 563), D1133L (SEQ ID NOS: 297, 295, 294, 293, 292, 291, 290, 289, 287, 285, 284, 283, 282, 281), CP312R (SEQ ID NOS: 274, 272, 269, 268, 267), A240L (SEQ ID NOS: 854, 853, 25), A238L (SEQ ID NOS: 23, 21, 19, 17), MGF100-1L (SEQ ID NOS: 572, 570); and most preferably selected from the group consisting of: MGF505-7R/MGF505-8R (SEQ ID NOS: 774, 772, 724, 722, 721, 719, 717), M448R (SEQ ID NOS: 568, 566, 565, 564, 563), D1133L (SEQ ID NOS: 297, 295, 294, 293, 292, 291, 290, 289, 287, 285, 284, 283, 282, 281), CP312R (SEQ ID NOS: 274, 272, 269, 268, 267), A240L (SEQ ID NOS: 854, 853, 25).

In yet another specific aspect, the immunogenic compositions or the vaccines or pharmaceutical compositions as described and/or claimed herein are provided, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: SEQ ID NOS: 18, 20, 22, 24, 26, 27, 270, 271, 273, 286, 288, 296, 298, 419, 421, 431, 433, 457, 459, 467, 469, 480, 482, 488, 490, 517, 519, 525, 527, 567, 569, 571, 573, 718, 720, 723, 725, 773, 775.

In yet another specific aspect, the immunogenic compositions or the vaccines or pharmaceutical compositions as described and/or claimed herein are provided, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF505-7R/MGF505-8R (SEQ ID NOS: 857, 775, 773, 725, 723, 720, 718), M448R (SEQ ID NOS: 858, 569, 567), D1133L (SEQ ID NOS: 859, 298, 296, 288, 286), CP312R (SEQ ID NOS: 861, 273, 901, 900, 271, 270), A240L (SEQ ID NOS: 860, 27, 26), A238L (SEQ ID NOS: 24, 22, 20, 18), MGF100-1L (SEQ ID NOS: 573, 571), K145R (SEQ ID NOS: 527, 525, 519, 517), B475L (SEQ ID NOS: 866, 867), H339R (SEQ ID NOS: 469, 467, 459, 457), I226R (SEQ ID NOS: 490, 488, 482, 480), CP2475L (p37) (SEQ ID NOS: 868, 869), CP2475L (p150) (SEQ ID NOS: 870, 871), G1211R (SEQ ID NOS: 433, 431, 421, 419), M1249L (SEQ ID NOS: 872, 873), MGF505-9R (SEQ ID NOS: 874, 875), P1192R (SEQ ID NOS: 876, 877), MGF505-1R (SEQ ID NOS: 878, 879), MGF505-3R (SEQ ID NOS: 880, 881), EP424R (SEQ ID NOS: 882, 883), C475L (SEQ ID NOS: 884, 885), B602L (SEQ ID NOS: 886, 887), CP530R (SEQ ID NOS: 888, 889), D339L (SEQ ID NOS: 890, 891), D117L (SEQ ID NOS: 863, 865), I243L (SEQ ID NOS: 892, 893), I73R (SEQ ID NOS: 894, 895), DP238L (SEQ ID NOS: 896, 897), I9R (SEQ ID NOS: 898, 899), preferably selected from the group consisting of: MGF505-7R/MGF505-8R (SEQ ID NOS: 857, 775, 773, 725, 723, 720, 718), M448R (SEQ ID NOS: 858, 569, 567), D1133L (SEQ ID NOS: 859, 298, 296, 288, 286), CP312R (SEQ ID NOS: 861, 273, 901, 900, 271, 270), A240L (SEQ ID NOS: 860, 27, 26), A238L (SEQ ID NOS: 24, 22, 20, 18), MGF100-1L (SEQ ID NOS: 573, 571); and most preferably selected from the group consisting of: MGF505-7R/MGF505-8R (SEQ ID NOS: 857, 775, 773, 725, 723, 720, 718), M448R (SEQ ID NOS: 858, 569, 567), D1133L (SEQ ID NOS: 859, 298, 296, 288, 286), CP312R (SEQ ID NOS: 861, 273, 901, 900, 271, 270), A240L (SEQ ID NOS: 860, 27, 26).

In yet another specific aspect, the immunogenic compositions or the vaccines or pharmaceutical compositions as described and/or claimed herein are provided, wherein according to (c) the viral or bacterial vector is selected from the group consisting of: asfivirus viral vector, avipox virus viral vector, canine morbillivirus viral vector, herpes virus viral vector, varicella virus viral vector, Lawsonia spp., *Salmonella* spp.

In yet another specific aspect, the immunogenic compositions or the vaccines or pharmaceutical compositions as described and/or claimed herein are provided, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof as herein disclosed and/or claimed.

In yet another specific aspect, the immunogenic compositions or the vaccines or pharmaceutical compositions as described and/or claimed herein are provided, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: MGF505-7R/MGF505-8R (SEQ ID NOS: 774, 772, 724, 722, 721, 719, 717), M448R (SEQ ID NOS: 568, 566, 565, 564, 563), D1133L (SEQ ID NOS: 297, 295, 294, 293, 292, 291, 290, 289, 287, 285, 284, 283, 282, 281), CP312R (SEQ ID NOS: 274, 272, 269, 268, 267), A240L (SEQ ID NOS: 854, 853, 25), A238L (SEQ ID NOS: 23, 21, 19, 17), MGF100-1L (SEQ ID NOS: 572, 570), K145R (SEQ ID NOS: 526, 524, 523, 522, 521, 520, 518, 516, 515, 514), B475L (SEQ ID NOS: 66, 65, 64, 63, 62, 61, 60, 59, 58, 57, 56, 55, 54, 53, 52, 51, 50, 49, 48), H339R (SEQ ID NOS: 468, 466, 465, 464, 463, 462, 461, 460, 458, 456, 455, 454), I226R (SEQ ID NOS: 489, 487, 486, 485, 484, 483, 481, 479, 478), CP2475L (p37) (SEQ ID NOS: 266, 265, 264, 263, 262, 261), CP2475L (p150) (SEQ ID NOS: 260, 259, 258), G1211R (SEQ ID NOS: 432, 430, 429, 428, 427, 426, 425, 424, 423, 422, 420, 418, 417, 416), M1249L (SEQ ID NOS: 562, 561, 560, 559, 558, 557, 556, 555, 554, 553, 552, 551, 550, 549, 548, 547, 546, 545, 544, 543, 542, 541, 540, 539), MGF505-9R (SEQ ID NOS: 733, 732, 731, 730, 729, 728, 727, 726), P1192R (SEQ ID NOS: 817, 816, 815, 814, 813, 812, 811, 810, 809, 808, 807, 806, 805, 804, 803, 802, 801), MGF505-1R (SEQ ID NOS: 692, 691, 690, 689, 688, 687, 686, 685, 684), MGF505-3R (SEQ ID NOS: 703, 702, 701, 700, 699), EP424R (SEQ ID NOS: 389, 388, 387, 386, 385, 384, 383, 382, 381, 380, 379), C475L (SEQ ID NOS: 201, 200, 199, 198, 197, 196, 195, 194, 193, 192, 191, 190, 189, 188), B602L (SEQ ID NOS: 75, 74, 73, 72, 71, 70, 69, 68, 67), CP530R (SEQ ID NOS: 278, 277, 276, 275), D339L (SEQ ID NOS: 322, 321, 320), D117L (SEQ ID NOS: 862, 864), I243L (SEQ ID NOS: 494, 493, 492, 491), I73R (SEQ ID NOS: 504, 503, 502), DP238L (SEQ ID NOS: 327, 326, 325), I9R (SEQ ID NOS: 513, 512, 511, 510), preferably selected from the group consisting of: MGF505-7R/MGF505-8R (SEQ ID NOS: 774, 772, 724, 722, 721, 719, 717), M448R (SEQ ID NOS: 568, 566, 565, 564, 563), D1133L (SEQ ID NOS: 297, 295, 294, 293, 292, 291, 290, 289, 287, 285, 284, 283, 282, 281), CP312R (SEQ ID NOS: 274, 272, 269, 268, 267), A240L (SEQ ID NOS: 854, 853, 25), A238L (SEQ ID NOS: 23, 21, 19, 17), MGF100-1L (SEQ ID NOS: 572, 570); and most preferably selected from the group consisting of: MGF505-7R/MGF505-8R (SEQ ID NOS: 774, 772, 724, 722, 721, 719, 717), M448R (SEQ ID NOS: 568, 566, 565, 564, 563), D1133L (SEQ ID NOS: 297, 295, 294, 293, 292, 291, 290, 289, 287, 285, 284, 283, 282, 281), CP312R (SEQ ID NOS: 274, 272, 269, 268, 267), A240L (SEQ ID NOS: 854, 853, 25).

In yet another specific aspect, the immunogenic compositions or the vaccines or pharmaceutical compositions as described and/or claimed herein are provided, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: SEQ ID NOS: 18, 20, 22, 24, 26, 27, 270, 271, 273, 286, 288, 296, 298, 419, 421, 431, 433, 457, 459, 467, 469, 480, 482, 488, 490, 517, 519, 525, 527, 567, 569, 571, 573, 718, 720, 723, 725, 773, 775.

In yet another specific aspect, the immunogenic compositions or the vaccines or pharmaceutical compositions as described and/or claimed herein are provided, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF505-7R/MGF505-8R (SEQ ID NOS: 857, 775, 773, 725, 723, 720, 718), M448R (SEQ ID NOS: 858, 569, 567), D1133L (SEQ ID NOS: 859, 298, 296, 288, 286), CP312R (SEQ ID NOS: 861, 273, 901, 900, 271, 270), A240L (SEQ ID NOS: 860, 27, 26), A238L (SEQ ID NOS: 24, 22, 20, 18), MGF100-1L (SEQ ID NOS: 573, 571), K145R (SEQ ID NOS: 527, 525, 519, 517), B475L (SEQ ID NOS: 866, 867), H339R (SEQ ID NOS: 469, 467, 459, 457), I226R (SEQ ID NOS: 490, 488, 482, 480), CP2475L (p37) (SEQ ID NOS: 868, 869), CP2475L (p150) (SEQ ID NOS: 870, 871), G1211R (SEQ ID NOS: 433, 431, 421, 419), M1249L (SEQ ID NOS: 872, 873), MGF505-9R (SEQ ID NOS: 874, 875), P1192R (SEQ ID NOS: 876, 877), MGF505-1R (SEQ ID NOS: 878, 879), MGF505-3R (SEQ ID NOS: 880, 881), EP424R (SEQ ID NOS: 882, 883), C475L (SEQ ID NOS: 884, 885), B602L (SEQ ID NOS: 886, 887), CP530R (SEQ ID NOS: 888, 889), D339L (SEQ ID NOS: 890, 891), D117L (SEQ ID NOS: 863, 865), I243L (SEQ ID NOS: 892, 893), I73R (SEQ ID NOS: 894, 895), DP238L (SEQ ID NOS: 896, 897), I9R (SEQ ID NOS: 898, 899), preferably selected from the group consisting of: MGF505-7R/MGF505-8R (SEQ ID NOS: 857, 775, 773, 725, 723, 720, 718), M448R (SEQ ID NOS: 858, 569, 567), D1133L (SEQ ID NOS: 859, 298, 296, 288, 286), CP312R (SEQ ID NOS: 861, 273, 271, (MGF505-7R)), A240L (SEQ ID NOS: 860, 27, 26), A238L (SEQ ID NOS: 24, 22, 20, 18), MGF100-1L (SEQ ID NOS: 573, 571); and most preferably selected from the group consisting of: MGF505-7R/MGF505-8R (SEQ ID NOS: 857, 775, 773, 725, 723, 720, 718), M448R (SEQ ID NOS: 858, 569, 567), D1133L (SEQ ID NOS: 859, 298, 296, 288, 286), CP312R (SEQ ID NOS: 861, 273, 901, 900, 271, 270), A240L (SEQ ID NOS: 860, 27, 26).

In yet another specific aspect, the immunogenic compositions or the vaccines or pharmaceutical compositions as described and/or claimed herein are provided, wherein the African swine fever virus polypeptides, preferably full-length proteins, comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: A238L (SEQ ID NO: 21), A238L (SEQ ID NO: 23), A240L (SEQ ID NO: 853), A240L (SEQ ID NO: 854), B475L (SEQ ID NO: 65), B475L (SEQ ID NO: 66), CP2475 (SEQ ID NO: 256), CP2475 (SEQ ID NO: 257), CP312R (SEQ ID NO: 272), CP312R (SEQ ID NO: 274), D1133L (SEQ ID NO: 295), D1133L (SEQ ID NO: 297), EP402R (SEQ ID NO: 378), EP424R (SEQ ID NO: 388), EP424R (SEQ ID NO: 389), G1211R (SEQ ID NO: 430), G1211R (SEQ ID NO: 432), H339R (SEQ ID NO: 466), H339R (SEQ ID NO: 468), I226R (SEQ ID NO: 487), I226R (SEQ ID NO: 489), K145R (SEQ ID NO: 524), K145R (SEQ ID NO: 526), M448R (SEQ ID NO: 566), M448R (SEQ ID NO: 568), M1249L (SEQ ID NO: 561), M1249L (SEQ ID NO: 562), MGF_100-1L/MGF100-1L (SEQ ID NO: 572), MGF505-1R/MGF_505-1R (SEQ ID NO: 691), MGF505-1R/MGF_505-1R (SEQ ID NO: 692), MGF505-8R/MGF_505-8R (SEQ ID NO: 722), MGF505-7R/MGF_505-7R (SEQ ID NO: 724), MGF505-8R/MGF_505-8R (SEQ ID NO: 772), MGF505-7R/MGF_505-7R (SEQ ID NO: 774), MGF505-9R/MGF_505-9R (SEQ ID NO: 732), MGF505-9R/MGF_505-9R (SEQ ID NO: 733), P1192R (SEQ ID NO: 816), P1192R (SEQ ID NO: 817) and/or wherein the African swine fever virus peptides and/or immunogenic fragments thereof and/or African swine fever virus polypeptide/full-length protein immunogenic fragments comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: A238L (SEQ ID NO: 17), A238L (SEQ ID NO: 19), A240L (SEQ ID NO: 25), B475L (SEQ ID NO: 48), B475L (SEQ ID NO: 49), B475L (SEQ ID NO: 50), B475L (SEQ ID NO: 51), B475L (SEQ ID NO: 52), B475L (SEQ ID NO: 53), B475L (SEQ ID NO: 54), B475L (SEQ ID NO: 55), B475L (SEQ ID NO: 56), B475L (SEQ ID NO: 57), B475L (SEQ ID NO: 58), B475L (SEQ ID NO: 59), B475L (SEQ ID NO: 60), B475L (SEQ ID NO: 61), B475L (SEQ ID NO: 62), B475L (SEQ ID NO: 63), B475L (SEQ ID NO: 64), CP2475 (SEQ ID NO: 235), CP2475 (SEQ ID NO: 236), CP2475 (SEQ ID NO: 237), CP2475 (SEQ ID NO: 238), CP2475 (SEQ ID NO: 239), CP2475 (SEQ ID NO: 240), CP2475 (SEQ ID NO: 241), CP2475 (SEQ ID NO: 242), CP2475 (SEQ ID NO: 243), CP2475 (SEQ ID NO: 244), CP2475 (SEQ ID NO: 245), CP2475 (SEQ ID NO: 246), CP2475 (SEQ ID NO: 247), CP2475 (SEQ ID NO: 248), CP2475 (SEQ ID NO: 249), CP2475 (SEQ ID NO: 250), CP2475 (SEQ ID NO: 251), CP2475 (SEQ ID NO: 252), CP2475 (SEQ ID NO: 253), CP2475 (SEQ ID NO: 254), CP2475 (SEQ ID NO: 255), CP2475L (p37) (SEQ ID NO: 261), CP2475L (p37) (SEQ ID NO: 262), CP2475L (p37) (SEQ ID NO: 263), CP2475L (p37) (SEQ ID NO: 264), CP2475L (p37) (SEQ ID NO: 265), CP2475L (p37) (SEQ ID NO: 266), CP2475L (p150) (SEQ ID NO: 258), CP2475L (p150) (SEQ ID NO: 259), CP2475L (p150) (SEQ ID NO: 260), CP312R (SEQ ID NO: 267), CP312R (SEQ ID NO: 268), CP312R (SEQ ID NO: 269), D1133L (SEQ ID NO: 281), D1133L (SEQ ID NO: 282), D1133L (SEQ ID NO: 283), D1133L (SEQ ID NO: 284), D1133L (SEQ ID NO: 285), D1133L (SEQ ID NO: 286), D1133L (SEQ ID NO: 287), D1133L (SEQ ID NO: 289), D1133L (SEQ ID NO: 290), D1133L (SEQ ID NO: 291), D1133L (SEQ ID NO: 292), D1133L (SEQ ID NO: 293), D1133L (SEQ ID NO: 294), EP402R (SEQ ID NO: 372), EP402R (SEQ ID NO: 373), EP402R (SEQ ID NO: 374), EP402R (SEQ ID NO: 375), EP402R (SEQ ID NO: 376), EP402R (SEQ ID NO: 377), EP424R (SEQ ID NO: 379), EP424R (SEQ ID NO: 380), EP424R (SEQ ID NO: 381), EP424R (SEQ ID NO: 382), EP424R (SEQ ID NO: 383), EP424R (SEQ ID NO: 384), EP424R (SEQ ID NO: 385), EP424R (SEQ ID NO: 386), EP424R (SEQ ID NO: 387), G1211R (SEQ ID NO: 416), G1211R (SEQ ID NO: 417), G1211R (SEQ ID NO: 418), G1211R (SEQ ID NO: 420), G1211R (SEQ ID NO: 422), G1211R (SEQ ID NO: 423), G1211R (SEQ ID NO: 424), G1211R (SEQ ID NO: 425), G1211R (SEQ ID NO: 426), G1211R (SEQ ID NO: 427), G1211R (SEQ ID NO: 428), G1211R (SEQ ID NO: 429), H339R (SEQ ID NO: 454), H339R (SEQ ID NO: 455), H339R (SEQ ID NO: 456), H339R (SEQ ID NO: 458), H339R (SEQ ID NO: 460), H339R (SEQ ID NO: 461), H339R (SEQ ID NO: 462), H339R (SEQ ID NO: 463), H339R (SEQ ID NO: 464), H339R (SEQ ID NO: 465), I226R (SEQ ID NO: 478), I226R (SEQ ID NO: 479), I226R (SEQ ID NO: 481), I226R (SEQ ID NO: 483), I226R (SEQ ID NO: 484), I226R (SEQ ID NO: 485), I226R (SEQ ID NO: 486), K145R (SEQ ID NO: 514), K145R (SEQ ID NO: 515), K145R (SEQ ID NO: 516), K145R (SEQ ID NO: 518), K145R (SEQ ID NO: 520), K145R (SEQ ID NO: 521), K145R (SEQ ID NO: 522), K145R (SEQ ID NO: 523), M448R (SEQ ID NO: 563), M448R (SEQ ID NO: 564), M448R (SEQ ID NO: 565), M1249L (SEQ ID NO: 539), M1249L (SEQ ID NO: 540), M1249L (SEQ ID NO: 541), M1249L (SEQ ID NO: 542), M1249L (SEQ ID NO: 543), M1249L (SEQ ID NO: 544), M1249L (SEQ ID NO: 545), M1249L (SEQ ID NO: 546), M1249L (SEQ ID NO: 547), M1249L (SEQ ID NO: 548), M1249L (SEQ ID NO: 549), M1249L (SEQ ID NO: 550), M1249L (SEQ ID NO: 551), M1249L (SEQ ID NO: 552), M1249L (SEQ ID NO: 553), M1249L (SEQ ID NO: 554), M1249L (SEQ ID NO: 555), M1249L (SEQ ID NO: 556), M1249L (SEQ ID NO: 557), M1249L (SEQ ID NO: 558), M1249L (SEQ ID NO: 559), M1249L (SEQ ID NO: 560), MGF_100-1L/MGF100-1L (SEQ ID NO: 570), MGF505-1R/MGF_505-1R (SEQ ID NO: 684), MGF505-1R/

MGF_505-1R (SEQ ID NO: 685), MGF505-1R/MGF_505-1R (SEQ ID NO: 686), MGF505-1R/MGF_505-1R (SEQ ID NO: 687), MGF505-1R/MGF_505-1R (SEQ ID NO: 688), MGF505-1R/MGF_505-1R (SEQ ID NO: 689), MGF505-1R/MGF_505-1R (SEQ ID NO: 690), MGF505-8R/MGF_505-8R (SEQ ID NO: 717), MGF505-7R/MGF_505-7R (SEQ ID NO: 719), MGF505-7R/MGF_505-7R (SEQ ID NO: 721), MGF505-9R/MGF_505-9R (SEQ ID NO: 726), MGF505-9R/MGF_505-9R (SEQ ID NO: 727), MGF505-9R/MGF_505-9R (SEQ ID NO: 728), MGF505-9R/MGF_505-9R (SEQ ID NO: 729), MGF505-9R/MGF_505-9R (SEQ ID NO: 730), MGF505-9R/MGF_505-9R (SEQ ID NO: 731), P1192R (SEQ ID NO: 801), P1192R (SEQ ID NO: 802), P1192R (SEQ ID NO: 803), P1192R (SEQ ID NO: 804), P1192R (SEQ ID NO: 805), P1192R (SEQ ID NO: 806), P1192R (SEQ ID NO: 807), P1192R (SEQ ID NO: 808), P1192R (SEQ ID NO: 809), P1192R (SEQ ID NO: 810), P1192R (SEQ ID NO: 811), P1192R (SEQ ID NO: 812), P1192R (SEQ ID NO: 813), P1192R (SEQ ID NO: 814), P1192R (SEQ ID NO: 815).

In yet another specific aspect, the immunogenic compositions or the vaccines or pharmaceutical compositions as described and/or claimed herein are provided, wherein the African swine fever virus polypeptides, preferably full-length proteins, comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: MGF505-7R/MGF505-8R (SEQ ID NOS: 774, 772, 724, 722), M448R (SEQ ID NOS: 568, 566), D1133L (SEQ ID NOS: 297, 295), CP312R (SEQ ID NOS: 274, 272), A240L (SEQ ID NOS: 854, 853), A238L (SEQ ID NOS: 23, 21), MGF100-1L (SEQ ID NO: 572), K145R (SEQ ID NOS: 526, 524), B475L (SEQ ID NOS: 66, 65), H339R (SEQ ID NOS: 468, 466), I226R (SEQ ID NOS: 489, 487), CP2475 (SEQ ID NO: 257), CP2475 (SEQ ID NO: 256), G1211R (SEQ ID NOS: 432, 430), M1249L (SEQ ID NOS: 562, 561), MGF505-9R (SEQ ID NOS: 733, 732), P1192R (SEQ ID NOS: 817, 816), MGF505-1R (SEQ ID NOS: 692, 691), MGF505-3R (SEQ ID NOS: 703, 702), EP424R (SEQ ID NOS: 389, 388), C475L (SEQ ID NOS: 201, 200), B602L (SEQ ID NOS: 75, 74), CP530R (SEQ ID NOS: 278, 277), D339L (SEQ ID NOS: 322, 321), D117L (SEQ ID NOS: 862, 864), I243L (SEQ ID NOS: 494, 493), I73R (SEQ ID NOS: 504, 503), DP238L (SEQ ID NOS: 327, 326), I9R (SEQ ID NOS: 513, 512) and/or wherein the African swine fever virus peptides and/or immunogenic fragments thereof and/or African swine fever virus polypeptide/full-length protein immunogenic fragments comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: MGF505-7R/MGF505-8R (SEQ ID NOS: 721, 719, 717), M448R (SEQ ID NOS: 565, 564, 563), D1133L (SEQ ID NOS: 294, 293, 292, 291, 290, 289, 287, 285, 284, 283, 282, 281), CP312R (SEQ ID NOS: 269, 268, 267), A240L (SEQ ID NO: 25), A238L (SEQ ID NOS: 19, 17), MGF100-1L (SEQ ID NO: 570), K145R (SEQ ID NOS: 523, 522, 521, 520, 518, 516, 515, 514), B475L (SEQ ID NOS: 64, 63, 62, 61, 60, 59, 58, 57, 56, 55, 54, 53, 52, 51, 50, 49, 48), H339R (SEQ ID NOS: 465, 464, 463, 462, 461, 460, 458, 456, 455, 454), I226R (SEQ ID NOS: 486, 485, 484, 483, 481, 479, 478), CP2475L (p37) (SEQ ID NOS: 266, 265, 264, 263, 262, 261), CP2475L (p150) (SEQ ID NOS: 260, 259, 258), G1211R (SEQ ID NOS: 429, 428, 427, 426, 425, 424, 423, 422, 420, 418, 417, 416), M1249L (SEQ ID NOS: 560, 559, 558, 557, 556, 555, 554, 553, 552, 551, 550, 549, 548, 547, 546, 545, 544, 543, 542, 541, 540, 539), MGF505-9R (SEQ ID NOS: 731, 730, 729, 728, 727, 726), P1192R (SEQ ID NOS: 815, 814, 813, 812, 811, 810, 809, 808, 807, 806, 805, 804, 803, 802, 801), MGF505-1R (SEQ ID NOS: 690, 689, 688, 687, 686, 685, 684), MGF505-3R (SEQ ID NOS: 701, 700, 699), EP424R (SEQ ID NOS: 387, 386, 385, 384, 383, 382, 381, 380, 379), C475L (SEQ ID NOS: 199, 198, 197, 196, 195, 194, 193, 192, 191, 190, 189, 188), B602L (SEQ ID NOS: 73, 72, 71, 70, 69, 68, 67), CP530R (SEQ ID NOS: 277, 276, 275), D339L (SEQ ID NO: 320), I243L (SEQ ID NOS: 492, 491), I73R (SEQ ID NO: 502), DP238L (SEQ ID NO: 325), I9R (SEQ ID NOS: 511, 510).

In yet another specific aspect, the immunogenic composition or the vaccine or pharmaceutical composition as described and/or claimed herein are provided, wherein the ASFV polypeptide is an ASFV full-length protein, preferably encoded by a polynucleotide sequence comprising, more preferably consisting of, any possible open reading frame (ORF), even more preferably encoded by a polynucleotide sequence comprising, most preferably consisting of, an open reading frame (ORF) with a 5'-end start codon and a 3'-end stop codon.

In yet another specific aspect, the immunogenic compositions or the vaccines or pharmaceutical compositions as described and/or claimed herein are provided, wherein the immunogenicity (and/or immunological response) of the immunogenic composition or the vaccine or pharmaceutical composition or any comprised immunogenic fragment is indicated/characterized by an induced IFN-gamma response, preferably in a porcine IFN-gamma ELISpot assay, more preferably in a porcine IFN-gamma ELISpot assay as described in Example 1.

In yet another specific aspect, the immunogenic compositions or the vaccines or pharmaceutical compositions as described and/or claimed herein are provided for use in a method of reducing or preventing the clinical signs or disease in porcines, preferably a pig, caused by an infection with at least one, preferably pathogenic, African swine fever virus or for use in a method of treating and/or preventing an infection with at least one, preferably pathogenic, African swine fever virus, wherein preferably said clinical signs or disease caused by an infection with at least one, preferably pathogenic, African swine fever virus or said infection with at least one, preferably pathogenic, African swine fever virus are selected from the group consisting of: African swine fever, acute African swine fever, chronic African swine fever, mortality, death, sudden death, fever, high fever, anorexia, lethargy, weakness, loss of appetite, recumbence, erythema, cyanotic skin blotching, diarrhea, constipation, abdominal pain, respiratory signs, coughing, vomiting, dyspnea, nasal and conjunctival discharges, hemorrhages, epistaxis, abortion, leukopenia, thrombocytopenia. A corresponding method of reducing or preventing the clinical signs or disease in porcines, preferably a pig, caused by an infection with at least one, preferably pathogenic, African swine fever virus or corresponding method of treating and/or preventing an infection with at least one, preferably pathogenic, African swine fever virus in porcines, preferably a pig, comprising administering to such porcine, preferably pig, the immunogenic compositions or the vaccines or pharmaceutical compositions as herein described and/or claimed, as well as the corresponding use of the immunogenic compositions or the vaccines or pharmaceutical compositions as herein described and/or claimed for the preparation of a medicament for reducing or preventing the clinical signs or disease in porcines, preferably a pig, caused by an infection with at least one, preferably pathogenic, African swine fever virus or for treating and/or preventing an infection with at least one, preferably pathogenic, African swine fever virus in porcines, preferably a pig, are also intended to be comprised by the present invention.

In yet another specific aspect, the immunogenic compositions or the vaccines or pharmaceutical compositions as described and/or claimed herein are provided for use in a method of immunizing a porcine, preferably a pig, against a clinical disease caused by at least one, preferably pathogenic, African swine fever virus in said porcine, preferably pig, said method comprising the step of administering to the porcine, preferably pig, the immunogenic composition or the vaccine or pharmaceutical composition as herein described and/or claimed, wherein said immunogenic composition or vaccine or pharmaceutical composition fails to cause clinical signs of infection but is capable of inducing an immune response that immunizes the porcine, preferably pig, against, preferably pathogenic forms of, said at least one African swine fever virus, wherein preferably said clinical disease or said clinical signs of infection are selected from the group consisting of: African swine fever, acute African swine fever, chronic African swine fever, mortality, death, sudden death, fever, high fever, anorexia, lethargy, weakness, loss of appetite, recumbence, erythema, cyanotic skin blotching, diarrhea, constipation, abdominal pain, respiratory signs, coughing, vomiting, dyspnea, nasal and conjunctival discharges, hemorrhages, epistaxis, abortion, leukopenia, thrombocytopenia. A corresponding method of immunizing a porcine, preferably a pig, against a clinical disease caused by at least one, preferably pathogenic, African swine fever virus in said porcine, preferably pig, said method comprising the step of administering to the porcine, preferably pig, the immunogenic composition or the vaccine or pharmaceutical composition as herein described and/or claimed, wherein said immunogenic composition or vaccine or pharmaceutical composition fails to cause clinical signs of infection but is capable of inducing an immune response that immunizes the porcine, preferably pig, against, preferably pathogenic forms of, said at least one African swine fever virus, as well as the corresponding use of the immunogenic compositions or the vaccines or pharmaceutical composition as herein described and/or claimed for the preparation of a medicament for immunizing a porcine, preferably a pig, against a clinical disease caused by at least one, preferably pathogenic, African swine fever virus in said porcine, preferably pig, wherein said immunogenic composition or vaccine or pharmaceutical composition fails to cause clinical signs of infection but is capable of inducing an immune response that immunizes the porcine, preferably pig, against, preferably pathogenic forms of, said at least one African swine fever virus, are also intended to be comprised by the present invention.

In yet another specific aspect, the immunogenic compositions or the vaccines or pharmaceutical compositions as described and/or claimed herein are provided for use in a method of prime-boost immunizing a porcine, preferably a pig, against a clinical disease caused by at least one, preferably pathogenic, African swine fever virus in said porcine, preferably pig, said method comprising the step of administering to the porcine, preferably pig, once or twice an immunogenic composition or the vaccine or pharmaceutical composition as herein described and/or claimed comprising (i) one, two or more African swine fever virus oligonucleotides and/or polynucleotides and/or immunogenic fragments thereof as sole immunogenic components or (ii) a viral or bacterial vector, preferably a recombinant and/or non-naturally occurring viral or bacterial vector, comprising one, two or more African swine fever virus oligonucleotides and/or polynucleotides and/or immunogenic fragments thereof as sole immunogenic component (priming step); and subsequently—after priming once or twice—administering to the porcine, preferably pig, a live attenuated African swine fever virus, preferably BA71ΔCD2 (boosting step); wherein said immunogenic composition or vaccine or pharmaceutical composition as well as the live attenuated African swine fever virus independently from each other fail to cause clinical signs of infection but are capable of inducing an immune response that immunizes the porcine, preferably pig, against, preferably pathogenic forms of, said at least one African swine fever virus, wherein preferably said clinical disease or said clinical signs of infection are selected from the group consisting of: African swine fever, acute African swine fever, chronic African swine fever, mortality, death, sudden death, fever, high fever, anorexia, lethargy, weakness, loss of appetite, recumbence, erythema, cyanotic skin blotching, diarrhea, constipation, abdominal pain, respiratory signs, coughing, vomiting, dyspnea, nasal and conjunctival discharges, hemorrhages, epistaxis, abortion, leukopenia, thrombocytopenia. A corresponding method of prime-boost immunizing a porcine, preferably a pig, against a clinical disease caused by at least one, preferably pathogenic, African swine fever virus in said porcine, preferably pig, said method comprising the step of administering to the porcine, preferably pig, once or twice an immunogenic composition or the vaccine or pharmaceutical composition as herein described and/or claimed comprising (i) one, two or more African swine fever virus oligonucleotides and/or polynucleotides and/or immunogenic fragments thereof as sole immunogenic components or (ii) a viral or bacterial vector, preferably a recombinant and/or non-naturally occurring viral or bacterial vector, comprising one, two or more African swine fever virus oligonucleotides and/or polynucleotides and/or immunogenic fragments thereof as sole immunogenic component (priming step); and subsequently—after priming once or twice—administering to the porcine, preferably pig, a live attenuated African swine fever virus, preferably BA71ΔCD2 (boosting step); wherein said immunogenic composition or vaccine or pharmaceutical composition as well as the live attenuated African swine fever virus independently from each other fail to cause clinical signs of infection but are capable of inducing an immune response that immunizes the porcine, preferably pig, against, preferably pathogenic forms of, said at least one African swine fever virus, as well as the corresponding use of the immunogenic compositions or the vaccines or pharmaceutical compositions as herein described and/or claimed for the preparation of a medicament for prime-boost immunizing a porcine, preferably a pig, against a clinical disease caused by at least one, preferably pathogenic, African swine fever virus in said porcine, preferably pig, are also intended to be comprised by the present invention.

In yet another specific aspect, a kit for vaccinating a porcine, preferably a pig, against a disease associated with and/or reducing the incidence or the severity of one or more clinical signs associated with or caused by at least one, preferably pathogenic, African swine fever virus in a porcine, preferably a pig, is provided comprising:
  (a) a dispenser capable of administering a vaccine to said porcine; and
  (b) the immunogenic composition or the vaccine or pharmaceutical composition as herein described and/or claimed, and (c) optionally, an instruction leaflet;
wherein preferably said disease or said clinical signs are selected from the group consisting of: African swine fever, acute African swine fever, chronic African swine fever, mortality, death, sudden death, fever, high fever, anorexia, lethargy, weakness, loss of appetite, recumbence, erythema, cyanotic skin blotching, diarrhea, constipation, abdominal pain, respiratory signs, coughing, vomiting, dyspnea, nasal and conjunctival discharges, hemorrhages, epistaxis, abortion, leukopenia, thrombocytopenia.

In yet another specific aspect, an African swine fever virus peptide and/or polypeptide, preferably full-length-protein, and/or immunogenic fragment thereof is provided comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: SEQ ID NOS: 1, 2, 3, 4, 5, 6, 7, 8, 9, 10, 11, 12, 13, 14, 15, 16, 17, 19, 21, 23, 25, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 1, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 272, 274, 275, 276, 277, 278, 279, 280, 281, 282, 283, 284, 285, 287, 289, 290, 291, 292, 293, 294, 295, 297, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 420, 422, 423, 424, 425, 426, 427, 428, 429, 430, 432, 434, 435, 436, 437, 438, 439, 440, 441, 442, 443, 444, 445, 446, 447, 448, 449, 450, 451, 452, 453, 454, 455, 456, 458, 460, 461, 462, 463, 464, 465, 466, 468, 470, 471, 472, 473, 474, 475, 476, 477, 478, 479, 481, 483, 484, 485, 486, 487, 489, 491, 492, 493, 494, 495, 496, 497, 498, 499, 500, 501, 502, 503, 504, 505, 506, 507, 508, 509, 510, 511, 512, 513, 514, 515, 516, 518, 520, 521, 522, 523, 524, 526, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 568, 570, 572, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693, 694, 695, 696, 697, 698, 699, 700, 701, 702, 703, 704, 705, 706, 707, 708, 709, 710, 711, 712, 713, 714, 715, 716, 717, 719, 721, 722, 724, 726, 727, 728, 729, 730, 731, 732, 733, 734, 735, 736, 737, 738, 739, 740, 741, 742, 743, 744, 745, 746, 747, 748, 749, 750, 751, 752, 753, 754, 755, 756, 757, 758, 759, 760, 761, 762, 763, 764, 765, 766, 767, 768, 769, 770, 771, 772, 774, 776, 777, 778, 779, 780, 781, 782, 783, 784, 785, 786, 787, 788, 789, 790, 791, 792, 793, 794, 795, 796, 797, 798, 799, 800, 801, 802, 803, 804, 805, 806, 807, 808, 809, 810, 811, 812, 813, 814, 815, 816, 817, 818, 819, 820, 821, 822, 823, 824, 825, 826, 827, 828, 829, 830, 831, 832, 833, 834, 835, 836, 837, 838, 839, 840, 841, 842, 843, 844, 845, 846, 847, 848, 849, 850, 851, 852, 853, 854.

In yet another specific aspect, an African swine fever virus peptide and/or polypeptide, preferably full-length-protein, and/or immunogenic fragment thereof is provided comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: MGF505-7R/MGF505-8R (SEQ ID NOS: 774, 772, 724, 722, 721, 719, 717), M448R (SEQ ID NOS: 568, 566, 565, 564, 563), D1133L (SEQ ID NOS: 297, 295, 294, 293, 292, 291, 290, 289, 287, 285, 284, 283, 282, 281), CP312R (SEQ ID NOS: 274, 272, 269, 268, 267), A240L (SEQ ID NOS: 854, 853, 25), A238L (SEQ ID NOS: 23, 21, 19, 17), MGF100-1L (SEQ ID NOS: 572, 570), K145R (SEQ ID NOS: 526, 524, 523, 522, 521, 520, 518, 516, 515, 514), B475L (SEQ ID NOS: 66, 65, 64, 63, 62, 61, 60, 59, 58, 57, 56, 55, 54, 53, 52, 51, 50, 49, 48), H339R (SEQ ID NOS: 468, 466, 465, 464, 463, 462, 461, 460, 458, 456, 455, 454), I226R (SEQ ID NOS: 489, 487, 486, 485, 484, 483, 481, 479, 478), CP2475L (p37) (SEQ ID NOS: 266, 265, 264, 263, 262, 261), CP2475L (p150) (SEQ ID NOS: 260, 259, 258), G1211R (SEQ ID NOS: 432, 430, 429, 428, 427, 426, 425, 424, 423, 422, 420, 418, 417, 416), M1249L (SEQ ID NOS: 562, 561, 560, 559, 558, 557, 556, 555, 554, 553, 552, 551, 550, 549, 548, 547, 546, 545, 544, 543, 542, 541, 540, 539), MGF505-9R (SEQ ID NOS: 733, 732, 731, 730, 729, 728, 727, 726), P1192R (SEQ ID NOS: 817, 816, 815, 814, 813, 812, 811, 810, 809, 808, 807, 806, 805, 804, 803, 802, 801), MGF505-1R (SEQ ID NOS: 692, 691, 690, 689, 688, 687, 686, 685, 684), MGF505-3R (SEQ ID NOS: 703, 702, 701, 700, 699), EP424R (SEQ ID NOS: 389, 388, 387, 386, 385, 384, 383, 382, 381, 380, 379), C475L (SEQ ID NOS: 201, 200, 199, 198, 197, 196, 195, 194, 193, 192, 191, 190, 189, 188), B602L (SEQ ID NOS: 75, 74, 73, 72, 71, 70, 69, 68, 67), CP530R (SEQ ID NOS: 278, 277, 276, 275), D339L (SEQ ID NOS: 322, 321, 320), D117L (SEQ ID NOS: 862, 864), I243L (SEQ ID NOS: 494, 493, 492, 491), I73R (SEQ ID NOS: 504, 503, 502), DP238L (SEQ ID NOS: 327, 326, 325), I9R (SEQ ID NOS: 513, 512, 511, 510), preferably selected from the group consisting of: MGF505-7R/MGF505-8R (SEQ ID NOS: 774, 772, 724, 722, 721, 719, 717), M448R (SEQ ID NOS: 568, 566, 565, 564, 563), D1133L (SEQ ID NOS: 297, 295, 294, 293, 292, 291, 290, 289, 287, 285, 284, 283, 282, 281), CP312R (SEQ ID NOS: 274, 272, 269, 268, 267), A240L (SEQ ID NOS: 854, 853, 25), A238L (SEQ ID NOS: 23, 21, 19, 17), MGF100-1L (SEQ ID NOS: 572, 570); and most preferably selected from the group consisting of: MGF505-7R/MGF505-8R (SEQ ID NOS: 774, 772, 724, 722, 721, 719, 717), M448R (SEQ ID NOS: 568, 566, 565, 564, 563), D1133L (SEQ ID NOS: 297, 295, 294, 293, 292, 291, 290, 289, 287, 285, 284, 283, 282, 281), CP312R (SEQ ID NOS: 274, 272, 269, 268, 267), A240L (SEQ ID NOS: 854, 853, 25).

In yet another specific aspect, an African swine fever virus peptide and/or polypeptide, preferably full-length-protein, and/or immunogenic fragment thereof is provided, wherein the African swine fever virus polypeptides, preferably full-length proteins, comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: A238L (SEQ ID NO: 21), A238L (SEQ ID NO: 23), A240L (SEQ ID NO: 853), A240L (SEQ ID NO: 854), B475L (SEQ ID NO: 65), B475L (SEQ ID NO: 66), CP2475 (SEQ ID NO: 256), CP2475 (SEQ ID NO: 257), CP312R (SEQ ID NO: 272), CP312R (SEQ ID NO: 274), D1133L (SEQ ID NO: 295), D1133L (SEQ ID NO: 297), EP402R (SEQ ID NO: 378), EP424R (SEQ ID NO: 388), EP424R (SEQ ID NO: 389), G1211R (SEQ ID NO: 430), G1211R (SEQ ID NO: 432), H339R (SEQ ID NO: 466), H339R (SEQ ID NO: 468), I226R (SEQ ID NO: 487), I226R (SEQ ID NO: 489), K145R (SEQ ID NO: 524), K145R (SEQ ID NO: 526), M448R (SEQ ID NO: 566), M448R (SEQ ID NO: 568), M1249L (SEQ ID NO: 561), M1249L (SEQ ID NO: 562), MGF_100-1L/MGF100-1L (SEQ ID NO: 572), MGF505-1R/MGF_505-1R (SEQ ID NO: 691), MGF505-1R/MGF_505-1R (SEQ ID NO: 692), MGF505-8R/MGF_505-8R (SEQ ID NO: 722), MGF505-7R/MGF_505-7R (SEQ ID NO: 724), MGF505-8R/MGF_505-8R (SEQ ID NO: 772), MGF505-7R/MGF_505-7R (SEQ ID NO: 774), MGF505-9R/MGF_505-9R (SEQ ID NO: 732), MGF505-9R/MGF_505-9R (SEQ ID NO: 733), P1192R (SEQ ID NO: 816), P1192R (SEQ ID NO: 817) and/or wherein the African swine fever virus peptides and/or immunogenic fragments thereof and/or African swine fever virus polypeptide/full-length protein immunogenic fragments comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: A238L (SEQ ID NO: 17), A238L (SEQ ID NO: 19), A240L (SEQ ID NO: 25), B475L (SEQ ID NO: 48), B475L (SEQ ID NO: 49), B475L (SEQ ID NO: 50), B475L (SEQ ID NO: 51), B475L (SEQ ID NO: 52), B475L (SEQ ID NO: 53), B475L (SEQ ID NO: 54), B475L (SEQ ID NO: 55), B475L (SEQ ID NO: 56), B475L (SEQ ID NO: 57), B475L (SEQ ID NO: 58), B475L (SEQ ID NO: 59), B475L (SEQ ID NO: 60), B475L (SEQ ID NO: 61), B475L (SEQ ID NO: 62), B475L (SEQ ID NO: 63), B475L (SEQ ID NO: 64), CP2475 (SEQ ID NO: 235), CP2475 (SEQ ID NO: 236), CP2475 (SEQ ID NO: 237), CP2475 (SEQ ID NO: 238), CP2475 (SEQ ID NO: 239), CP2475 (SEQ ID NO: 240), CP2475 (SEQ ID NO: 241), CP2475 (SEQ ID NO: 242), CP2475 (SEQ ID NO: 243), CP2475 (SEQ ID NO: 244), CP2475 (SEQ ID NO: 245), CP2475 (SEQ ID NO: 246), CP2475 (SEQ ID NO: 247), CP2475 (SEQ ID NO: 248), CP2475 (SEQ ID NO: 249), CP2475 (SEQ ID NO: 250), CP2475 (SEQ ID NO: 251), CP2475 (SEQ ID NO: 252), CP2475 (SEQ ID NO: 253), CP2475 (SEQ ID NO: 254), CP2475 (SEQ ID NO: 255), CP2475L (p37) (SEQ ID NO: 261), CP2475L (p37) (SEQ ID NO: 262), CP2475L (p37) (SEQ ID NO: 263), CP2475L (p37) (SEQ ID NO: 264), CP2475L (p37) (SEQ ID NO: 265), CP2475L (p37) (SEQ ID NO: 266), CP2475L (p150) (SEQ ID NO: 258), CP2475L (p150) (SEQ ID NO: 259), CP2475L (p150) (SEQ ID NO: 260), CP312R (SEQ ID NO: 267), CP312R (SEQ ID NO: 268), CP312R (SEQ ID NO: 269), D1133L (SEQ ID NO: 281), D1133L (SEQ ID NO: 282), D1133L (SEQ ID NO: 283), D1133L (SEQ ID NO: 284), D1133L (SEQ ID NO: 285), D1133L (SEQ ID NO: 287), D1133L (SEQ ID NO: 289), D1133L (SEQ ID NO: 290), D1133L (SEQ ID NO: 291), D1133L (SEQ ID NO: 292), D1133L (SEQ ID NO: 293), D1133L (SEQ ID NO: 294), EP402R (SEQ ID NO: 372), EP402R (SEQ ID NO: 373), EP402R (SEQ ID NO: 374), EP402R (SEQ ID NO: 375), EP402R (SEQ ID NO: 376), EP402R (SEQ ID NO: 377), EP424R (SEQ ID NO: 379), EP424R (SEQ ID NO: 380), EP424R (SEQ ID NO: 381), EP424R (SEQ ID NO: 382), EP424R (SEQ ID NO: 383), EP424R (SEQ ID NO: 384), EP424R (SEQ ID NO: 385), EP424R (SEQ ID NO: 386), EP424R (SEQ ID NO: 387), G1211R (SEQ ID NO: 416), G1211R (SEQ ID NO: 417), G1211R (SEQ ID NO: 418), G1211R (SEQ ID NO: 420), G1211R (SEQ ID NO: 422), G1211R (SEQ ID NO: 423), G1211R (SEQ ID NO: 424), G1211R (SEQ ID NO: 425), G1211R (SEQ ID NO: 426), G1211R (SEQ ID NO: 427), G1211R (SEQ ID NO: 428), G1211R (SEQ ID NO: 429), H339R (SEQ ID NO: 454), H339R (SEQ ID NO: 455), H339R (SEQ ID NO: 456), H339R (SEQ ID NO: 458), H339R (SEQ ID NO: 460), H339R (SEQ ID NO: 461), H339R (SEQ ID NO: 462), H339R (SEQ ID NO: 463), H339R (SEQ ID NO: 464), H339R (SEQ ID NO: 465), I226R (SEQ ID NO: 478), I226R (SEQ ID NO: 479), I226R (SEQ ID NO: 481), I226R (SEQ ID NO: 483), I226R (SEQ ID NO: 484), I226R (SEQ ID NO: 485), I226R (SEQ ID NO: 486), K145R (SEQ ID NO: 514), K145R (SEQ ID NO: 515), K145R (SEQ ID NO: 516), K145R (SEQ ID NO: 518), K145R (SEQ ID NO: 520), K145R (SEQ ID NO: 521), K145R (SEQ ID NO: 522), K145R (SEQ ID NO: 523), M448R (SEQ ID NO: 563), M448R (SEQ ID NO: 564), M448R (SEQ ID NO: 565), M1249L (SEQ ID NO: 539), M1249L (SEQ ID NO: 540), M1249L (SEQ ID NO: 541), M1249L (SEQ ID NO: 542), M1249L (SEQ ID NO: 543), M1249L (SEQ ID NO: 544), M1249L (SEQ ID NO: 545), M1249L (SEQ ID NO: 546), M1249L (SEQ ID NO: 547), M1249L (SEQ ID NO: 548), M1249L (SEQ ID NO: 549), M1249L (SEQ ID NO: 550), M1249L (SEQ ID NO: 551), M1249L (SEQ ID NO: 552), M1249L (SEQ ID NO: 553), M1249L (SEQ ID NO: 554), M1249L (SEQ ID NO: 555), M1249L (SEQ ID NO: 556), M1249L (SEQ ID NO: 557), M1249L (SEQ ID NO: 558), M1249L (SEQ ID NO: 559), M1249L (SEQ ID NO: 560), MGF_100-1L/MGF100-1L (SEQ ID NO: 570), MGF505-1R/MGF_505-1R (SEQ ID NO: 684), MGF505-1R/MGF_505-1R (SEQ ID NO: 685), MGF505-1R/MGF_505-1R (SEQ ID NO: 686), MGF505-1R/MGF_505-1R (SEQ ID NO: 687), MGF505-1R/MGF_505-1R (SEQ ID NO: 688), MGF505-1R/MGF_505-1R (SEQ ID NO: 689), MGF505-1R/MGF_505-1R (SEQ ID NO: 690), MGF505-8R/MGF_505-8R (SEQ ID NO: 717), MGF505-7R/MGF_505-7R (SEQ ID NO: 719), MGF505-7R/MGF_505-7R (SEQ ID NO: 721), MGF505-9R/MGF_505-9R (SEQ ID NO: 726), MGF505-9R/MGF_505-9R (SEQ ID NO: 727), MGF505-9R/MGF_505-9R (SEQ ID NO: 728), MGF505-9R/MGF_505-9R (SEQ ID NO: 729), MGF505-9R/MGF_505-9R (SEQ ID NO: 730), MGF505-9R/MGF_505-9R (SEQ ID NO: 731), P1192R (SEQ ID NO: 801), P1192R (SEQ ID NO: 802), P1192R (SEQ ID NO: 803), P1192R (SEQ ID NO: 804), P1192R (SEQ ID NO: 805), P1192R (SEQ ID NO: 806), P1192R (SEQ ID NO: 807), P1192R (SEQ ID NO: 808), P1192R (SEQ ID NO: 809), P1192R (SEQ ID NO: 810), P1192R (SEQ ID NO: 811), P1192R (SEQ ID NO: 812), P1192R (SEQ ID NO: 813), P1192R (SEQ ID NO: 814), P1192R (SEQ ID NO: 815).

In yet another specific aspect, an African swine fever virus peptide and/or polypeptide, preferably full-length-protein, and/or immunogenic fragment thereof is provided, wherein the African swine fever virus polypeptides, preferably full-length proteins, comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: MGF505-7R/MGF505-8R (SEQ ID NOS: 774, 772, 724, 722), M448R (SEQ ID NOS: 568, 566), D1133L (SEQ ID NOS: 297, 295), CP312R (SEQ ID NOS: 274, 272), A240L (SEQ ID NOS: 854, 853), A238L (SEQ ID NOS: 23, 21), MGF100-1L (SEQ ID NO: 572), K145R (SEQ ID NOS: 526, 524), B475L (SEQ ID NOS: 66, 65), H339R (SEQ ID NOS: 468, 466), I226R (SEQ ID NOS: 489, 487), CP2475 (SEQ ID NO: 257), CP2475 (SEQ ID NO: 256), G1211R (SEQ ID NOS: 432, 430), M1249L (SEQ ID NOS: 562, 561), MGF505-9R (SEQ ID NOS: 733, 732), P1192R (SEQ ID NOS: 817, 816), MGF505-1R (SEQ ID NOS: 692, 691), MGF505-3R (SEQ ID NOS: 703, 702), EP424R (SEQ ID NOS: 389, 388), C475L (SEQ ID NOS: 201, 200), B602L (SEQ ID NOS: 75, 74), CP530R (SEQ ID NOS: 278, 277), D339L (SEQ ID NOS: 322, 321), D117L (SEQ ID NOS: 862, 864), I243L (SEQ ID NOS: 494, 493), I73R (SEQ ID NOS: 504, 503), DP238L (SEQ ID NOS: 327, 326), I9R (SEQ ID NOS: 513, 512) and/or wherein the African swine fever virus peptides and/or immunogenic fragments thereof and/or African swine fever virus polypeptide/full-length protein immunogenic fragments comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: MGF505-7R/MGF505-8R (SEQ ID NOS: 721, 719, 717), M448R (SEQ ID NOS: 565, 564, 563), D1133L (SEQ ID NOS: 294, 293, 292, 291, 290, 289, 287, 285, 284, 283, 282, 281), CP312R (SEQ ID NOS: 269, 268, 267), A240L (SEQ ID NO: 25), A238L (SEQ ID NOS: 19, 17), MGF100-1L (SEQ ID NO: 570), K145R (SEQ ID NOS: 523, 522, 521, 520, 518, 516, 515, 514), B475L (SEQ ID NOS: 64, 63, 62, 61, 60, 59, 58, 57, 56, 55, 54, 53, 52, 51, 50, 49, 48), H339R (SEQ ID NOS: 465, 464, 463, 462, 461, 460, 458, 456, 455, 454), I226R (SEQ ID NOS: 486, 485, 484, 483, 481, 479, 478), CP2475 (p37) (SEQ ID NOS: 266, 265, 264, 263, 262, 261), CP2475L (p150) (SEQ ID NOS: 260, 259, 258), G1211R (SEQ ID NOS: 429, 428, 427, 426, 425, 424, 423, 422, 420, 418, 417, 416), M1249L (SEQ ID NOS: 560, 559, 558, 557, 556, 555, 554, 553, 552, 551, 550, 549, 548, 547, 546, 545, 544, 543, 542, 541, 540, 539), MGF505-9R (SEQ ID NOS: 731, 730, 729, 728, 727, 726), P1192R (SEQ ID NOS: 815, 814, 813, 812, 811, 810, 809, 808, 807, 806, 805, 804, 803, 802, 801), MGF505-1R (SEQ ID NOS: 690, 689, 688, 687, 686, 685, 684), MGF505-3R (SEQ ID NOS: 701, 700, 699), EP424R (SEQ ID NOS: 387, 386, 385, 384, 383, 382, 381, 380, 379), C475L (SEQ ID NOS: 199, 198, 197, 196, 195, 194, 193, 192, 191, 190, 189, 188), B602L (SEQ ID NOS: 73, 72, 71, 70, 69, 68, 67), CP530R (SEQ ID NOS: 277, 276, 275), D339L (SEQ ID NO: 320), I243L (SEQ ID NOS: 492, 491), I73R (SEQ ID NO: 502), DP238L (SEQ ID NO: 325), I9R (SEQ ID NOS: 511, 510).

In yet another specific aspect, an African swine fever virus oligonucleotide and/or polynucleotide and/or immunogenic fragment thereof is provided encoding the African swine fever virus peptide and/or polypeptide, preferably full-length-protein, and/or immunogenic fragment thereof as herein described and/or claimed.

In yet another specific aspect, an African swine fever virus oligonucleotide and/or polynucleotide and/or immunogenic fragment thereof is provided encoding the African swine fever virus peptide and/or polypeptide, preferably full-length-protein, and/or immunogenic fragment thereof comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: SEQ ID NOS: 18, 20, 22, 24, 26, 27, 270, 271, 273, 286, 288, 296, 298, 419, 421, 431, 433, 457, 459, 467, 469, 480, 482, 488, 490, 517, 519, 525, 527, 567, 569, 571, 573, 718, 720, 723, 725, 773, 775.

In yet another specific aspect, an African swine fever virus oligonucleotide and/or polynucleotide and/or immunogenic fragment thereof is provided encoding the African swine fever virus peptide and/or polypeptide, preferably full-length-protein, and/or immunogenic fragment thereof comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF505-7R/MGF505-8R (SEQ ID NOS: 857, 775, 773, 725, 723, 720, 718), M448R (SEQ ID NOS: 858, 569, 567), D1133L (SEQ ID NOS: 859, 298, 296, 288, 286), CP312R (SEQ ID NOS: 861, 273, 901, 900, 271, 270), A240L (SEQ ID NOS: 860, 27, 26), A238L (SEQ ID NOS: 24, 22, 20, 18), MGF100-1L (SEQ ID NOS: 573, 571), K145R (SEQ ID NOS: 527, 525, 519, 517), B475L (SEQ ID NOS: 866, 867), H339R (SEQ ID NOS: 469, 467, 459, 457), I226R (SEQ ID NOS: 490, 488, 482, 480), CP2475L (p37) (SEQ ID NOS: 868, 869), CP2475L (p150) (SEQ ID NOS: 870, 871), G1211R (SEQ ID NOS: 433, 431, 421, 419), M1249L (SEQ ID NOS: 872, 873), MGF505-9R (SEQ ID NOS: 874, 875), P1192R (SEQ ID NOS: 876, 877), MGF505-1R (SEQ ID NOS: 878, 879), MGF505-3R (SEQ ID NOS: 880, 881), EP424R (SEQ ID NOS: 882, 883), C475L (SEQ ID NOS: 884, 885), B602L (SEQ ID NOS: 886, 887), CP530R (SEQ ID NOS: 888, 889), D339L (SEQ ID NOS: 890, 891), D117L (SEQ ID NOS: 863, 865), I243L (SEQ ID NOS: 892, 893), I73R (SEQ ID NOS: 894, 895), DP238L (SEQ ID NOS: 896, 897), I9R (SEQ ID NOS: 898, 899); preferably selected from the group consisting of: MGF505-7R/MGF505-8R (SEQ ID NOS: 857, 775, 773, 725, 723, 720, 718), M448R (SEQ ID NOS: 858, 569, 567), D1133L (SEQ ID NOS: 859, 298, 296, 288, 286), CP312R (SEQ ID NOS: 861, 273, 901, 900, 271, 270), A240L (SEQ ID NOS: 860, 27, 26), A238L (SEQ ID NOS: 24, 22, 20, 18), MGF100-1L (SEQ ID NOS: 573, 571); and most preferably selected from the group consisting of: MGF505-7R/MGF505-8R (SEQ ID NOS: 857, 775, 773, 725, 723, 720, 718), M448R (SEQ ID NOS: 858, 569, 567), D1133L (SEQ ID NOS: 859, 298, 296, 288, 286), CP312R (SEQ ID NOS: 861, 273, 901, 900, 271, 270), A240L (SEQ ID NOS: 860, 27, 26).

In yet another specific aspect, the African swine fever virus peptide and/or polypeptide, preferably full-length-protein, and/or immunogenic fragment thereof as herein described and/or claimed or the African swine fever virus oligonucleotide and/or polynucleotide and/or immunogenic fragment thereof encoding African swine fever virus peptide and/or polypeptide, preferably full-length-protein, and/or immunogenic fragments thereof as herein described and/or claimed is provided, wherein the ASFV polypeptide is an ASFV full-length protein, preferably encoded by a polynucleotide sequence comprising, more preferably consisting of, any possible open reading frame (ORF), even more preferably encoded by a polynucleotide sequence comprising, most preferably consisting of, an open reading frame (ORF) with a 5'-end start codon and a 3'-end stop codon.

In yet another specific aspect, the African swine fever virus peptide and/or polypeptide, preferably full-length-protein, and/or immunogenic fragment thereof as herein described and/or claimed or the African swine fever virus oligonucleotide and/or polynucleotide and/or immunogenic fragment thereof encoding African swine fever virus peptide and/or polypeptide, preferably full-length-protein, and/or immunogenic fragments thereof as herein described and/or claimed is provided, wherein the immunogenicity (and/or immunological response) of the immunogenic composition or the vaccine or pharmaceutical composition or any comprised immunogenic fragment is indicated/characterized by an induced IFN-gamma response, preferably in a porcine IFN-gamma ELISpot assay, more preferably in a porcine IFN-gamma ELISpot assay as described in Example 1.

In yet another specific aspect, a vector comprising one, two, three or more African swine fever virus oligonucleotides and/or polynucleotides and/or immunogenic fragments thereof as herein described and/or claimed is provided. Preferably, such vector comprises three African swine fever virus oligonucleotides and/or polynucleotides and/or immunogenic fragments thereof, preferably selected from EP402R, CP312R and A240L (multiepitope-I, ME-I), more preferably comprises, most preferably consists of, the nucleic acid sequence selected from the group consisting of SEQ ID NO: 855; or comprises thirteen African swine fever virus oligonucleotides and/or polynucleotides and/or immunogenic fragments thereof, preferably selected from D1133L, G1211R, M1249L, MGF505-9R, P1192R, CP2475L (p150), B475L, EP424R, H339R, I226R, K145R, MGF505-1R and CP2475L (p37) (multiepitope-II, ME-II), more preferably comprises, most preferably consists of, the nucleic acid sequence selected from the group consisting of SEQ ID NO: 856.

In yet another specific aspect, a host cell, preferably a mammalian host cell, is provided comprising the vector as herein described and/or claimed.

Definitions

Unless defined otherwise, all technical and scientific terms used herein have the same meaning as is commonly understood by one of skill in the art to which this invention belongs at the time of filing. The meaning and scope of terms should be clear; however, in the event of any latent ambiguity, definitions provided herein take precedent over any dictionary or extrinsic definition. Further, unless otherwise required by context, singular terms shall include pluralities and plural terms shall include the singular. Herein, the use of "or" means "and/or" unless stated otherwise. Furthermore, the use of the term "including", as well as other forms such as "includes" and "included" is not limiting. All patents and publications referred to herein are incorporated by reference herein.

The practice of the present invention will employ, unless otherwise indicated, conventional techniques of virology, molecular biology, microbiology, recombinant DNA technology, protein chemistry and immunology, which are within the skill of the art. Such techniques are explained fully in the literature. See, e.g., Sambrook, Fritsch & Maniatis, Molecular Cloning: A Laboratory Manual, Vols. I, II and III, Second Edition (1989); DNA Cloning, Vols. I and II (D. N. Glover ed. 1985); Oligonucleotide Synthesis (M. J. Gait ed. 1984); Nucleic Acid Hybridization (B. D. Hames & S. J. Higgins eds. 1984); Animal Cell Culture (R. K. Freshney ed. 1986); Immobilized Cells and Enzymes (IRL press, 1986); Perbal, B., A Practical Guide to Molecular Cloning (1984); the series, Methods In Enzymology (S. Colowick and N. Kaplan eds., Academic Press, Inc.); Protein purification methods—a practical approach (E. L. V. Harris and S. Angal, eds., IRL Press at Oxford University Press); and Handbook of Experimental Immunology, Vols. I-IV (D. M. Weir and C. C. Blackwell eds., 1986, Blackwell Scientific Publications).

Before describing the present invention in detail, it is to be understood that this invention is not limited to particular DNA, polypeptide sequences or process parameters as such may, of course, vary. It is also to be understood that the terminology used herein is for the purpose of describing particular embodiments of the invention only, and is not intended to be limiting. It must be noted that, as used in this specification and the appended claims, the singular forms "a", "an" and "the" include plural referents unless the content clearly dictates otherwise. Thus, for example, reference to "an antigen" includes a mixture of two or more antigens, reference to "an excipient" includes mixtures of two or more excipients, and the like.

The term "viral or bacterial vector" describes a genetically modified virus or bacterium, which was manipulated by recombinant DNA technique in a way so that its entry into a host cell results in a specific biological activity, e.g. the expression of a transgene, such as an ASFV gene, carried by the vector. In a specific aspect, the transgene is an ASFV antigen. A viral or bacterial vector may or may not be replication competent in the target cell, tissue, or organism. In this context, the terms "viral vector" and "virus" are used interchangeably—as are the terms "bacterial vector" and "bacterium".

Generation of a viral or bacterial vector can be accomplished using any suitable genetic engineering techniques well known in the art, including, without limitation, the standard techniques of restriction endonuclease digestion, ligation, transformation, plasmid purification, DNA sequencing, transfection in cell cultures, for example as described in Sambrook et al. (Molecular Cloning: A Laboratory Manual Cold Spring Harbor Laboratory Press, N.Y. (1989)) or K. Maramorosch and H. Koprowski (Methods in Virology Volume VIII, Academic Press Inc. London, UK (2014)).

A viral or bacterial vector can include coding regions for two or more proteins of interest. For example, the viral or bacterial vector can include the coding region for a first protein of interest and the coding region for a second protein of interest. The first protein of interest and the second protein of interest can be the same or different. In some embodiments, the viral or bacterial vector can include the coding region(s) for a third or a fourth protein of interest. The third and the fourth protein of interest can be the same or different. The total length of the two or more proteins of interest encoded by one viral or bacterial vector can vary. For example, the total length of the two or more proteins can be at least about 200 amino acids. At least about 250 amino acids, at least about 300 amino acids, at least about 350 amino acids, at least about 400 amino acids, at least about 450 amino acids, at least about 500 amino acids, at least about 550 amino acids, at least about 600 amino acids, at least about 650 amino acids, at least about 700 amino acids, at least about 750 amino acids, at least about 800 amino acids, or longer.

According to specific aspects of the present invention, the term "viral or bacterial vector" or alternatively "viral or bacterial construct" refers to a recombinant viral or bacterial construct derived from a virus or bacterium, which is selected from the group consisting of: asfivirus viral vector, avipox virus viral vector, canine morbillivirus viral vector, herpes virus viral vector, varicella virus viral vector, Lawsonia spp., *Salmonella* spp.

The terms "viral or bacterial vector" and "viral or bacterial construct" can be used interchangeably.

The term "construct," as used herein, refers to a recombinant nucleic acid such as a plasmid, a BAC, or a recombinant virus or bacterium that has been artificially generated.

The term "plasmid" refers to cytoplasmic DNA that replicates independently of the bacterial chromosome within a bacterial host cell. In a specific aspect of the present invention the term "plasmid" and/or "transfer plasmid" refers to an element of recombinant DNA technology useful for construction of e.g. an expression cassette for insertion into a viral vector. In another specific aspect the term "plasmid" may be used to specify a plasmid useful for DNA vaccination purposes.

As used herein, the terms "nucleic acid" and "polynucleotide" are interchangeable and refer to any nucleic acid.

The term "nucleic acid", "nucleic acid sequence", "nucleotide sequence", "RNA sequence", cDNA sequences or "DNA sequence" as used herein refers to an oligonucleotide, nucleotide or polynucleotide and fragments and portions thereof and to DNA or RNA of genomic or synthetic origin, which may be single or double stranded and represent the sense or antisense strand. The sequence may be a non-coding sequence, a coding sequence or a mixture of both. The nucleic acid sequences of the present invention can be prepared using standard techniques well known to one of skill in the art.

The term "nucleic acid", "nucleic acid sequence" and "nucleotide sequence" also specifically include nucleic acids composed of bases other than the five biologically occurring bases (adenine, guanine, thymine, cytosine and uracil).

The term "complementary nucleotide sequences" describes one strand of the two paired strands of polynucleotides such as DNA or RNA. The nucleotide sequence of the complementary strand mirrors the nucleotide sequence of its paired strand so that for each adenosin it contains a thymin (or uracil for RNA), for each guanine a cytosin, and vice versa. The complementary nucleotide sequence of e.g. 5'-GCATAC-3' is 3'-CGTATG-5' or for RNA 3'-CGUAUG-5'.

The term "expression" as used herein refers to transcription and/or translation of a nucleic acid sequence within a host cell. According to specific aspects of the present invention the term "expression" refers to transcription and/or translation of a heterologous and/or exogenous nucleic acid sequence within a host cell. The level of expression of a desired product in a host cell may be determined on the basis of either the amount of corresponding RNA or mRNA that is present in the cell, or the amount of the desired polypeptide encoded by the selected sequence. For example, mRNA transcribed from a selected sequence can be quantitated by Northern blot hybridization, ribonuclease RNA protection, in situ hybridization to cellular RNA or by RTqPCR (reverse transcription followed by quantitative PCR). Proteins expressed from a selected sequence can be quantitated by various methods, e.g. by ELISA, by Western blotting, by radioimmunoassays, by immunoprecipitation, by assaying for the biological activity of the protein, or by immunostaining of the protein followed by FACS analysis.

The term "virus load" is well known to the person skilled in that art. The term virus load is interchangeable used with the term "viral titer" herein. The virus load or virus titer is a measure of the severity of an active viral infection, and can be determined by methods known to the person skilled in the art. The determination can be based on the detection of viral proteins such as by antibody binding to the viral proteins and further detection or, alternatively, by detection of viral nucleic acids by amplification methods such as RT-PCR. Monitoring of virion associated viral RNA in plasma by nucleic acid amplification methods is a widely used parameter to assess the status and progression of retroviral disease, and to evaluate the effectiveness of prophylactic and therapeutic interventions. Exemplary, the virus load or virus titer can be calculated by estimating the live amount of virus in an involved body fluid such as a number of RNA copies per milliliter of blood plasma. Preferably, the term "virus load" or "virus titer" is a measure of infectious units per volume of a virus preparation. Viral titer is an endpoint in a biological procedure and is defined as the dilution at which a certain proportion of tests carried out in parallel show an effect. Specifically the tissue culture infectious dose fifty per milliliter (TCID50/ml) gives the dilution of a virus preparation at which 50% of a number of cell cultures inoculated in parallel with that dilution are infected.

By definition, every nucleotide sequence or every gene inserted in a host cell and the respective protein or RNA encoded thereby is referred to as "exogenous", "exogenous sequence", "exogenous gene", "exogenous coding sequence", "exogenous antigen encoding sequence" with respect to the host cell, when it comes from a different (virus or bacterium) species.

By definition, every nucleotide sequence or every gene inserted in a host cell and the respective protein or RNA encoded thereby is referred to as "heterologous, "heterologous sequence", "heterologous gene", "heterologous coding sequence", "transgene" or "heterologous protein" with respect to the host cell. This applies even if the sequence to be introduced or the gene to be introduced is identical to an endogenous sequence or an endogenous gene of the host cell. For example, a specific promoter sequence introduced into an viral or bacterial vector at a different site or in modified form than in the wild type virus or bacterium is by definition a heterologous sequence. As used herein in respect to a sequence or gene of interest such as an antigen, the term "heterologous" means that said sequence or gene of interest, specifically said antigen, is expressed out of its natural subspecies context.

The term "non-naturally occurring" means any sequence or gene of interest such as an antigen, which is not occurring in this context naturally, such as a hybrid sequence or a sequence or gene of interest such as an antigen from a different species, or sequence or gene of interest such as an antigen, which is not a product of nature due to artificial mutation, insertion, deletion or the like.

The term "recombinant" is used interchangeably with the terms "non-naturally occurring", "heterologous" and "exogenous" throughout the specification of this present invention. Thus, a "recombinant" protein is a protein expressed from a either a heterologous or an exogenous nucleotide sequence. The term recombinant as used with respect to a virus or bacterium means a virus or bacterium produced by artificial manipulation of the viral or bacterial genome. A virus or bacterium comprising a heterologous or an exogenous sequence such as an exogenous antigen encoding sequence is a recombinant virus or bacterium. The term recombinant virus or bacterium and the term non-naturally occurring virus or bacterium are used interchangeably.

Thus, the term "heterologous vector" means a vector that comprises a heterologous or an exogenous nucleotide sequence. The term "recombinant vector" means a vector that comprises a heterologous or a recombinant nucleotide sequence.

"Sequence homology", as used herein, refers to a method of determining the relatedness of two sequences. To determine sequence homology, two or more sequences are optimally aligned, and gaps are introduced if necessary. However, in contrast to "sequence identity", conservative amino acid substitutions are counted as a match when determining sequence homology. In other words, to obtain a polypeptide or polynucleotide having 95% sequence homology with a reference sequence, 85%, preferably 90%, 91%, 92%, 93%, 94%, even more preferably 95%, 96%, 97%, 98%, 99%, 99.9% of the amino acid residues or nucleotides in the reference sequence must match or comprise a conservative substitution with another amino acid or nucleotide, or a number of amino acids or nucleotides up to 15%, preferably up to 10%, 9%, 8%, 7%, 6%, even more preferably up to 5%, 4%, 3%, 2%, 1%, 0.1% of the total amino acid residues or nucleotides, not including conservative substitutions, in the reference sequence may be inserted into the reference sequence. Preferably the homologue sequence comprises at least a stretch of 50, even more preferred of 100, even more preferred of 250, even more preferred of 500 nucleotides.

"Sequence Identity" as it is known in the art refers to a relationship between two or more polypeptide sequences or two or more polynucleotide sequences, namely a reference sequence and a given sequence to be compared with the reference sequence. Sequence identity is determined by comparing the given sequence to the reference sequence after the sequences have been optimally aligned to produce the highest degree of sequence similarity, as determined by the match between strings of such sequences. Upon such alignment, sequence identity is ascertained on a position-by-position basis, e.g., the sequences are "identical" at a particular position if at that position, the nucleotides or amino acid residues are identical. The total number of such position identities is then divided by the total number of nucleotides or residues in the reference sequence to give % sequence identity. Sequence identity can be readily calculated by known methods, including but not limited to, those described in Computational Molecular Biology, Lesk, A. N., ed., Oxford University Press, New York (1988), Biocomputing: Informatics and Genome Projects, Smith, D. W., ed., Academic Press, New York (1993); Computer Analysis of Sequence Data, Part I, Griffin, A. M., and Griffin, H. G., eds., Humana Press, New Jersey (1994); Sequence Analysis in Molecular Biology, von Heinge, G., Academic Press (1987); Sequence Analysis Primer, Gribskov, M. and Devereux, J., eds., M. Stockton Press, New York (1991); and Carillo, H., and Lipman, D., SIAM J. Applied Math., 48: 1073 (1988), the teachings of which are incorporated herein by reference. Preferred methods to determine the sequence identity are designed to give the largest match between the sequences tested. Methods to determine sequence identity are codified in publicly available computer programs which determine sequence identity between given sequences. Examples of such programs include, but are not limited to, the GCG program package (Devereux, J., et al., Nucleic Acids Research, 12(1):387 (1984)), BLASTP, BLASTN and FASTA (Altschul, S. F. et al., J. Molec. Biol., 215:403-410 (1990). The BLASTX program is publicly available from NCBI and other sources (BLAST Manual, Altschul, S. et al., NCVI NLM NIH Bethesda, Md. 20894, Altschul, S. F. et al., J. Molec. Biol., 215:403-410 (1990), the teachings of which are incorporated herein by reference). These programs optimally align sequences using default gap weights in order to produce the highest level of sequence identity between the given and reference sequences. As an illustration, by a polynucleotide having a nucleotide sequence having at least, for example, 85%, preferably 90%, 91%, 92%, 93%, 94%, even more preferably 95%, 96%, 97%, 98%, 99%, 99.9% "sequence identity" to a reference nucleotide sequence, it is intended that the nucleotide sequence of the given polynucleotide is identical to the reference sequence except that the given polynucleotide sequence may include up to 15, preferably up to 10, even more preferably up to 5 point mutations per each 100 nucleotides of the reference nucleotide sequence. In other words, in a polynucleotide having a nucleotide sequence having at least 85%, preferably 90%, 91%, 92%, 93%, 94%, even more preferably 95%, 96%, 97%, 98%, 99%, 99.9% identity relative to the reference nucleotide sequence, up to 15%, preferably 10%, 9%, 8%, 7%, 6%, even more preferably 5%, 4%, 3%, 2%, 1%, 0.1% of the nucleotides in the reference sequence may be deleted or substituted with another nucleotide, or a number of nucleotides up to 15%, preferably 10%, 9%, 8%, 7%, 6%, even more preferably 5%, 4%, 3%, 2%, 1%, 0.1% of the total nucleotides in the reference sequence may be inserted into the reference sequence. These mutations of the reference sequence may occur at the 5' or 3' terminal positions of the reference nucleotide sequence or anywhere between those terminal positions, interspersed either individually among nucleotides in the reference sequence or in one or more contiguous groups within the reference sequence. Analogously, by a polypeptide having a given amino acid sequence having at least, for example, 85%, preferably 90%, 91%, 92%, 93%, 94%, even more preferably 95%, 96%, 97%, 98%, 99% sequence identity to a reference amino acid sequence, it is intended that the given amino acid sequence of the polypeptide is identical to the reference sequence except that the given polypeptide sequence may include up to 15, preferably up to 10, 9, 8, 7, 6, even more preferably up to 5, 4, 3, 2, 1 amino acid alterations per each 100 amino acids of the reference amino acid sequence. In other words, to obtain a given polypeptide sequence having at least 85%, preferably 90%, 91%, 92%, 93%, 94%, even more preferably 95%, 96%, 97%, 98%, 99% sequence identity with a reference amino acid sequence, up to 15%, preferably up to 10%, 9%, 8%, 7%, even more preferably up to 5%, 4%, 3%, 2%, 1% of the amino acid residues in the reference sequence may be deleted or substituted with another amino acid, or a number of amino acids up to 15%, preferably up to 10%, 9%, 8%, 7%, even more preferably up to 5%, 4%, 3%, 2%, 1% of the total number of amino acid residues in the reference sequence may be inserted into the reference sequence. These alterations of the reference sequence may occur at the amino or the carboxy terminal positions of the reference amino acid sequence or anywhere between those terminal positions, interspersed either individually among residues in the reference sequence or in the one or more contiguous groups within the reference sequence. Preferably, residue positions, which are not identical, differ by conservative amino acid substitutions. However, conservative substitutions are not included as a match when determining sequence identity.

The terms "sequence identity" or "percent identity" are used interchangeably herein. For the purpose of this invention, it is defined here that in order to determine the percent identity of two amino acid sequences or two nucleic acid sequences, the sequences are aligned for optimal comparison purposes (e.g., gaps can be introduced in the sequence of a first amino acid or nucleic acid for optimal alignment with a second amino or nucleic acid sequence). The amino acid or nucleotide residues at corresponding amino acid or nucleotide positions are then compared. When a position in the first sequence is occupied by the same amino acid or nucleotide residue as the corresponding position in the second sequence, then the molecules are identical at that position. The percent identity between the two sequences is a function of the number of identical positions shared by the sequences (i.e., % identity=number of identical positions/total number of positions (i.e. overlapping positions)×100). Preferably, the two sequences are the same length.

A sequence comparison may be carried out over the entire lengths of the two sequences being compared or over fragment of the two sequences. Typically and preferred in the scope of the present invention, the comparison will be carried out over the full length of the two sequences being compared. However, sequence identity may be carried out over a region of, for example, twenty, fifty, one hundred or more contiguous amino acid residues.

As used herein, it is in particular understood that the term "having at least X % sequence identity with the nucleic acid/amino acid sequence according to SEQ ID NO:Y" (or, alternatively, the term "having at least X % sequence identity with the nucleic acid/amino acid sequence of/set forth in SEQ ID NO:Y") is equivalent to the term "having at least X % sequence identity with the nucleic acid/amino acid sequence according to SEQ ID NO:Y over the length of SEQ ID NO:Y" or to the term "having at least X % sequence identity with the nucleic acid/amino acid sequence according to SEQ ID NO:Y over the whole length of SEQ ID NO:Y", respectively.

The skilled person will be aware of the fact that several different computer programs are available to determine the homology between two sequences. For instance, a comparison of sequences and determination of percent identity between two sequences can be accomplished using a mathematical algorithm. In a specific aspect, the percent identity between two amino acid or nucleic acid sequences is determined using the Needleman and Wunsch (J. Mol. Biol. (48): 444-453 (1970)) algorithm which has been incorporated into the GAP program in the Accelrys GCG software package, using either a Blosum 62 matrix or a PAM250 matrix, and a gap weight of 16, 14, 12, 10, 8, 6, or 4 and a length weight of 1, 2, 3, 4, 5, or 6. The skilled person will appreciate that all these different parameters will yield slightly different results but that the overall percentage identity of two sequences is not significantly altered when using different algorithms.

The protein sequences or nucleic acid sequences of the present invention can further be used as a "query sequence" to perform a search against public databases to, for example, identify other family members or related sequences. Such searches can be performed using the BLASTN and BLASTP programs (version 2.0) of Altschul, et al. (1990) J. Mol. Biol. 215:403-10. BLAST protein searches can be performed with the BLASTP program, score=50, wordlength=3 to obtain amino acid sequences homologous to protein molecules of the invention. To obtain gapped alignments for comparison purposes, Gapped BLAST can be utilized as described in Altschul et al. (1997) Nucleic Acids Res. 25(17): 3389-3402. When utilizing BLAST and Gapped BLAST programs, the default parameters of the respective programs (e.g., BLASTP and BLASTN) can be used. See the homepage of the National Center for Biotechnology Information.

The term "porcine" in the scope of the present invention refers to pigs and any of the animals in the genus Sus. The term "pigs" include the domestic pig (Sus scrofa domesticus) and wild pigs (Sus scrofa scrofa) as well as warthogs (Potamochoerus porcus), bushpigs (Potamochoerus larvatus), giant forest hogs (Hylochoerus meinertzhageni) and feral pigs. It has to be understood that pigs comprises female and male animals Semen may contain ASFV, and for that reason female and male breeding animals are encompassed by the wording "porcine". Thus, the wordings "porcine" and "pig" comprises male animals such as boars as well as female animals such as gilts and sows. The term "gilt", as used herein, refers to a porcine, preferably a pig, before and during first gestation/pregnancy. In contrast, the term "sow", as used herein, refers to a porcine, preferably a pig, after first farrowing, as a positive result of its first gestation/pregnancy. Preferably, the "porcine" is a pig, in particular a domestic pig.

An "immunogenic or immunological composition" generally refers to a composition of matter that comprises at least one antigen, or immunogenic portion thereof, that elicits an immunological response in the host of a cellular or antibody-mediated immune response to the composition. Preferably, the immunogenic composition induces an immune response and, more preferably, confers protective immunity against one or more of the clinical signs of an ASFV infection. In case where the host displays a protective immunological response such that resistance to new infection will be enhanced and/or the clinical severity of the disease reduced, the immunogenic composition is described as a "vaccine".

The term "antigen" used herein is well understood in the art and includes substances which are immunogenic, i.e., immunogens, as well as substances which induce immunological unresponsiveness, or anergy, i.e., a lack of reactions by the body's defense mechanisms to foreign substances. As used herein, the term "antigen" is intended to mean full-length proteins as well as peptide fragments thereof containing or comprising epitope. Further, the term "antigen encoding sequence" relates to sequences encoding an antigen. Preferably the antigen encoding sequence is a nucleic acid sequence such as a cDNA sequence.

An "immunogenic composition" as herein specifically described and claimed comprises one, two, or more ASFV peptides and/or polypeptides, preferably full-length proteins, and/or immunogenic fragments thereof, such as for example an ASFV surface protein and/or immunogenic fragment(s) thereof; or one, two or more ASFV oligonucleotides and/or polynucleotides and/or immunogenic fragments thereof encoding ASFV peptides and/or polypeptides, preferably full-length proteins, and/or immunogenic fragments thereof; or a viral or bacterial vector, preferably a recombinant and/or non-naturally occurring viral or bacterial vector, comprising one, two or more ASFV oligonucleotides and/or polynucleotides and/or immunogenic fragments thereof encoding ASFV peptides and/or polypeptides, preferably full-length proteins, and/or immunogenic fragments thereof; that elicit an immunological response and/or immunogenicity as described herein.

The term "immunogenic fragment" or "immunogenic portion" or "immunogenic fragment(s) thereof" in the course of the present invention refers to a fragment or truncated and/or substituted form of an ASFV peptide, polypeptide or full-length protein as well as to a fragment or truncated and/or substituted form of a corresponding encoding ASFV oligonucleotide or polynucleotide, all of which including one or more epitopes and thus eliciting the immunological response and/or immunogenicity as described herein. In the course of the present invention, for instance an immunogenic fragment of an ASFV full-length protein can be either an ASFV polypeptide or an ASFV peptide.

Depending on the length and/or nature of such an ASFV peptide, such ASFV peptide can also comprise more than one epitope—therefore it is even possible in the course of the present invention that one or more immunogenic fragments of a given ASFV peptide exists—depending on the number of epitopes comprised. Further, in the course of the present invention, for instance an immunogenic fragment of a corresponding encoding ASFV polynucleotide can be a corresponding encoding ASFV oligonucleotide. Depending on the length and/or nature of such an ASFV oligonucleotide, such ASFV oligonucleotide can also comprise more than one epitope—therefore it is also possible in the course of the present invention that one or more immunogenic fragments of a given ASFV oligonucleotide exists—depending on the number of epitopes comprised. Moreover, in the course of the present invention, such ASFV oligonucleotides and/or polynucleotides are either immunogenic per se, i.e. the given nucleic acid as such is immunogenic and comprises at least one epitope and thus elicits the immunological response and/or immunogenicity as described herein. Alternatively, in the course of the present invention, such ASFV oligonucleotides and/or polynucleotides are not immunogenic per se, but encode an ASFV peptide, polypeptide or full-length protein, which is immunogenic and comprises at least one epitope and thus elicits the immunological response and/or immunogenicity as described herein. Preferably, such fragment or truncated and/or substituted form of an ASFV peptide, polypeptide or full-length protein as well as fragment or truncated and/or substituted form of a corresponding encoding ASFV oligonucleotide or polynucleotide will comprise 2 to 1000, 3 to 500, 4 to 300, 5 to 200, 6 to 180 or 7 to 150 contiguous amino acid residues in length from an ASFV peptide, polypeptide or full-length protein; more preferably at least 4, 5, 6, 7, 8, 9, 10, 11, 12, 13, 14, 15, 16, 17, 18, 19, 20, 21, 22, 23, 24, 25, 30, 35, 40, 45, 50, 55, 60, 65, 70, 75, 80, 85, 90, 95, 100, 120, 140, 160, 180, 200 or more contiguous amino acid residues in length from an ASFV peptide, polypeptide or full-length protein; or will comprise 6 to 3000, 9 to 1500, 12 to 900, 15 to 600, 18 to 540 or 21 to 450 contiguous nucleotides in length of the corresponding encoding ASFV oligonucleotide or polynucleotide; more preferably at least 12, 15, 18, 20, 21, 25, 30, 35, 40, 45, 50, 55, 60, 65, 70, 75, 80, 85, 90, 95, 100, 150, 200, 250, 300, 350, 400, 450, 500, 550, 600, 650, 700, 750, 800, 850, 900, 950, 1000 or more contiguous nucleotides in length of the corresponding encoding ASFV oligonucleotide or polynucleotide.

Such fragments can be identified using any number of epitope mapping techniques, well known in the art. See, e.g., Epitope Mapping Protocols in Methods in Molecular Biology, Vol. 66 (Glenn E. Morris, Ed., 1996) Humana Press, Totowa, N.J. For example, linear epitopes may be determined by concurrently synthesizing large numbers of peptides on solid supports, the peptides corresponding to portions of the protein molecule, and reacting the peptides with antibodies while the peptides are still attached to the supports. Such techniques are known and described in the art, see e.g., U.S. Pat. No. 4,708,871; Geysen et al. (1984) Proc. Natl. Acad. Sci. USA 81:3998-4002; and Geysen et al. (1986) Molec. Immunol. 23:709-715. Similarly, conformational epitopes are readily identified by determining spatial conformation of amino acids such as by, e.g., x-ray crystallography and two-dimensional nuclear magnetic resonance. See Epitope Mapping Protocols, supra. Synthetic antigens are also included within the definition, for example, polyepitopes, flanking epitopes, and other recombinant or synthetically derived antigens. See, e.g., Bergmann et al. (1993) Eur. J. Immunol. 23:2777-2781; Bergmann et al. (1996), J. Immunol. 157:3242-3249; Suhrbier, A. (1997), Immunol. and Cell Biol. 75:402-408; and Gardner et al., (1998) 12th World AIDS Conference, Geneva, Switzerland, Jun. 28-Jul. 3, 1998. The teachings and content of which are all incorporated by reference herein.

The term "ASFV peptide" in the course of the present invention refers to an amino acid sequence consisting of two or more, but no more than 50 amino acid residues, more preferably 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acid residues, comprising at least one epitope and thus eliciting the immunological response and/or immunogenicity as described herein.

The term "ASFV polypeptide" in the course of the present invention refers to an amino acid sequence consisting of more than 50 amino acid residues, comprising at least one epitope and thus eliciting the immunological response and/or immunogenicity as described herein.

The term "ASFV full-length protein" refers to an ASFV polypeptide encoded by a polynucleotide sequence comprising, more preferably consisting of, any possible open reading frame (ORF), preferably encoded by a polynucleotide sequence comprising, more preferably consisting of, an open reading frame (ORF) with a 5'-end start codon and a 3'-end stop codon.

The term "ASFV oligonucleotide" in the course of the present invention refers to a nucleotide sequence of at least two, but no more than 12 nucleotides, which can comprise at least one epitope and thus elicit the immunological response and/or immunogenicity as described herein.

The term "ASFV polynucleotide" in the course of the present invention refers to a nucleotide sequence of 13 or more nucleotides, which can comprise at least one epitope and thus elicit the immunological response and/or immunogenicity as described herein.

The term "immunizing" relates to an active immunization by the administration of an immunogenic composition to a porcine to be immunized, thereby causing an immunological response against the antigen included in such immunogenic composition.

The term "in need" or "of need", as used herein means that the administration/treatment is associated with the boosting or improvement in health or clinical signs or any other positive medicinal effect on health of the animals which receive the immunogenic composition in accordance with the present invention.

The term "vaccine" as used herein refers to a pharmaceutical composition comprising at least one immunologically active component that induces an immunological response in an animal and possibly but not necessarily one or more additional components that enhance the immunological activity of the active component. A vaccine may additionally comprise further components typical to pharmaceutical compositions. By way of distinction the immunologically active component of a vaccine may comprise complete virus particles in either their original form or as attenuated particles in a so called modified live vaccine (MLV) or particles inactivated by appropriate methods in a so called killed vaccine (KV). In another form the immunologically active component of a vaccine may comprise appropriate elements of the organisms (subunit vaccines), such as for instance peptides and/or polypeptides, preferably full-length proteins, as well as oligonucleotides and/or polynucleotides, whereby these elements are generated either by destroying the whole particle or the growth cultures containing such particles and optionally subsequent purification steps yielding the desired structure(s), or by synthetic processes including an appropriate manipulation by use of a suitable system based on, for example, bacteria, insects, mammalian, or other species plus optionally subsequent isolation and purification procedures, or by induction of the synthetic processes in the animal needing a vaccine by direct incorporation of genetic or material using suitable pharmaceutical compositions (polynucleotide vaccination). A vaccine may comprise one or simultaneously more than one of the elements described above. As used within specific aspects of the present invention "vaccine" refers to a live vaccine or live virus, also called recombinant vaccine. In another specific aspect of the present invention "vaccine" refers to an inactivated or killed virus including virus like particles (VLPs). Thus, a vaccine may be a subunit vaccine or a killed (KV) or inactivated vaccine.

The term "DNA vaccination" or "polynucleotide vaccination" means direct inoculation of genetic material using suitable pharmaceutical compositions.

Various physical and chemical methods of inactivation are known in the art. The term "inactivated" refers to a previously virulent or non-virulent virus that has been irradiated (ultraviolet (UV), X-ray, electron beam or gamma radiation), heated, or chemically treated to inactivate or kill such virus while retaining its immunogenicity. Suitable inactivating agents include beta-propiolactone, binary or beta- or acetyl-ethyleneimine, gluteraldehyde, ozone, and formalin (formaldehyde).

For inactivation by formalin or formaldehyde, formaldehyde is typically mixed with water and methyl alcohol to create formalin. The addition of methyl alcohol prevents degradation or cross reaction during the in activation process. One embodiment uses about 0.1 to 1% of a 37% solution of formaldehyde to inactivate the virus. It is critical to adjust the amount of formalin to ensure that the material is inactivated but not so much that side effects from a high dosage occur.

More particularly, the term "inactivated" in the context of a virus means that the virus is incapable of replication in vivo or in vitro. For example, the term "inactivated" may refer to a virus that has been propagated in vitro, and has then been inactivated using chemical or physical means so that it is no longer capable of replicating.

As used herein, the terms "inactivated", "killed" or "KV" are used interchangeably.

The term "live vaccine" refers to a vaccine comprising either a living organism or a replication competent virus or viral vector.

A "pharmaceutical composition" essentially consists of one or more ingredients capable of modifying physiological, e.g., immunological functions, of the organism it is administered to, or of organisms living in or on the organism. The term includes, but is not restricted to, antibiotics or antiparasitics, as well as other constituents commonly used to achieve certain other objectives such as, but not limited to, processing traits, sterility, stability, feasibility to administer the composition via enteral or parenteral routes such as oral, intranasal, intravenous, intramuscular, subcutaneous, intradermal, or other suitable route, tolerance after administration, or controlled release properties. One non-limiting example of such a pharmaceutical composition, solely given for demonstration purposes, could be prepared as follows: cell culture supernatant of an infected cell culture is mixed with a stabilizer (e.g., spermidine and/or bovine serum albumin (BSA) and the mixture is subsequently lyophilized or dehydrated by other methods. Prior to vaccination, the mixture is then rehydrated in aqueous (e.g., saline, phosphate buffered saline (PBS) or non-aqueous solutions (e.g., oil emulsion, aluminum-based adjuvant).

As used herein, "pharmaceutical- or veterinary-acceptable carrier" includes any and all solvents, dispersion media, coatings, adjuvants, stabilizing agents, diluents, preservatives, antibacterial and antifungal agents, isotonic agents, adsorption delaying agents, and the like. In some specific aspects, and especially those that include lyophilized immunogenic compositions, stabilizing agents for use in the present invention include stabilizers for lyophilization or freeze-drying.

In some embodiments, the immunogenic composition of the present invention contains an adjuvant. "Adjuvants" as used herein, can include aluminum hydroxide and aluminum phosphate, saponins e.g., Quil A, QS-21 (Cambridge Biotech Inc., Cambridge Mass.), GPI-0100 (Galenica Pharmaceuticals, Inc., Birmingham, Ala.), water-in-oil emulsion, oil-in-water emulsion, water-in-oil-in-water emulsion. The emulsion can be based in particular on light liquid paraffin oil (European Pharmacopea type); isoprenoid oil such as squalane or squalene; oil resulting from the oligomerization of alkenes, in particular of isobutene or decene; esters of acids or of alcohols containing a linear alkyl group, more particularly plant oils, ethyl oleate, propylene glycol di-(caprylate/caprate), glyceryl tri-(caprylate/caprate) or propylene glycol dioleate; esters of branched fatty acids or alcohols, in particular isostearic acid esters. The oil is used in combination with emulsifiers to form the emulsion. The emulsifiers are preferably nonionic surfactants, in particular esters of sorbitan, of mannide (e g anhydromannitol oleate), of glycol, of polyglycerol, of propylene glycol and of oleic, isostearic, ricinoleic or hydroxystearic acid, which are optionally ethoxylated, and polyoxypropylene-polyoxyethylene copolymer blocks, in particular the Pluronic products, especially L121. See Hunter et al., The Theory and Practical Application of Adjuvants (Ed. Stewart-Tull, D. E. S.), John Wiley and Sons, NY, pp 51-94 (1995) and Todd et al., Vaccine 15:564-570 (1997). Exemplary adjuvants are the SPT emulsion described on page 147 of "Vaccine Design, The Subunit and Adjuvant Approach" edited by M. Powell and M. Newman, Plenum Press, 1995, and the emulsion MF59 described on page 183 of this same book.

A further instance of an adjuvant is a compound chosen from the polymers of acrylic or methacrylic acid and the copolymers of maleic anhydride and alkenyl derivative. Advantageous adjuvant compounds are the polymers of acrylic or methacrylic acid which are cross-linked, especially with polyalkenyl ethers of sugars or polyalcohols. These compounds are known by the term carbomer (Phameuropa Vol. 8, No. 2, June 1996). Persons skilled in the art can also refer to U.S. Pat. No. 2,909,462 which describes such acrylic polymers cross-linked with a polyhydroxylated compound having at least 3 hydroxyl groups, preferably not more than 8, the hydrogen atoms of at least three hydroxyls being replaced by unsaturated aliphatic radicals having at least 2 carbon atoms. The preferred radicals are those containing from 2 to 4 carbon atoms, e.g. vinyls, allyls and other ethylenically unsaturated groups. The unsaturated radicals may themselves contain other substituents, such as methyl. The products sold under the name CARBOPOL®; (BF Goodrich, Ohio, USA) are particularly appropriate. They are cross-linked with an allyl sucrose or with allyl pentaerythritol. Among then, there may be mentioned Carbopol 974P, 934P and 971P. Most preferred is the use of CARBOPOL® 971P. Among the copolymers of maleic anhydride and alkenyl derivative, are the copolymers EMA (Monsanto), which are copolymers of maleic anhydride and ethylene. The dissolution of these polymers in water leads to an acid solution that will be neutralized, preferably to physiological pH, in order to give the adjuvant solution into which the immunogenic, immunological or vaccine composition itself will be incorporated.

Further suitable adjuvants include, but are not limited to, the RIBI adjuvant system (Ribi Inc.), Block co-polymer (CytRx, Atlanta Ga.), SAF-M (Chiron, Emeryville Calif.), monophosphoryl lipid A, Avridine lipid-amine adjuvant, heat-labile enterotoxin from E. coli (recombinant or otherwise), cholera toxin, IMS 1314 or muramyl dipeptide, or naturally occurring or recombinant cytokines or analogs thereof or stimulants of endogenous cytokine release, among many others.

It is expected that an adjuvant can be added in an amount of about 100 µg to about 10 mg per dose, preferably in an amount of about 100 µg to about 10 mg per dose, more preferably in an amount of about 500 µg to about 5 mg per dose, even more preferably in an amount of about 750 µg to about 2.5 mg per dose, and most preferably in an amount of about 1 mg per dose. Alternatively, the adjuvant may be at a concentration of about 0.01 to 50%, preferably at a concentration of about 2% to 30%, more preferably at a concentration of about 5% to 25%, still more preferably at a concentration of about 7% to 22%, and most preferably at a concentration of 10% to 20% by volume of the final product.

"Diluents" can include water, saline, dextrose, ethanol, glycerol, and the like. Isotonic agents can include sodium chloride, dextrose, mannitol, sorbitol, and lactose, among others. Stabilizers include albumin and alkali salts of ethylendiamintetracetic acid, among others.

"Isolated" means altered "by the hand of man" from its natural state, i.e., if it occurs in nature, it has been changed or removed from its original environment, or both. For example, a polynucleotide or polypeptide naturally present in a living organism is not "isolated," but the same polynucleotide or polypeptide separated from the coexisting materials of its natural state is "isolated", as the term is employed herein.

"Attenuation" means reducing the virulence of a pathogen. In the present invention "attenuation" is synonymous with "avirulent". In the present invention, an attenuated virus is one in which the virulence has been reduced so that it does not cause clinical signs of infection but is capable of inducing an immune response in the target animal, but may also mean that the clinical signs are reduced in incidence or severity in animals infected with the attenuated virus in comparison with a "control group" of animals infected with non-attenuated virus or pathogen and not receiving the attenuated virus. In this context, the term "reduce/reduced" means a reduction of at least 10%, preferably 25%, even more preferably 50%, still more preferably 60%, even more preferably 70%, still more preferably 80%, even more preferably 90% and most preferably of 100% as compared to the control group as defined above. Thus, an attenuated, avirulent pathogen such as for example an attenuated viral or bacterial vector as claimed is suitable for the generation of a modified live vaccine (MLV) or modified live immunogenic composition.

The terms "treatment and/or prophylaxis" and "reducing or preventing the clinical signs or disease" refer to the lessening of the incidence of the particular ASFV infection or the reduction in the severity of clinical signs caused by or associated with the particular ASFV infection. Thus, the terms "treatment and/or prophylaxis" and "reducing or preventing the clinical signs or disease" also refer to the reduction of the number of animals that become infected with the particular ASFV (=lessening of the incidence of the ASFV infection) or to the reduction of the severity of clinical signs normally associated with or caused by an ASFV infection in a group of animals which animals have received an effective amount of the immunogenic composition as provided herein in comparison to a group of animals which animals have not received such immunogenic composition. The terms "treatment and/or prophylaxis" and "reducing or preventing the clinical signs or disease" generally involve the administration of an effective amount of the immunogenic composition of the present invention to an animal or animals in need of or that could benefit from such a treatment/prophylaxis/reduction/prevention. The term "treatment" refers to the administration of the effective amount of the immunogenic composition once the animal or at least some animals is/are already infected with such ASFV and wherein such animals already show some clinical signs caused by or associated with such ASFV infection. The terms "prophylaxis" and "preventing" refer to the administration to an animal prior to any infection of such animal with ASFV or at least where such animal or none of the animals in a group of animals do not show any clinical signs caused by or associated with the infection by such ASFV. The terms "prophylaxis" and "preventing" are used interchangeably in this application.

The term "clinical signs" as used herein refers to signs of infection of an animal from ASFV. The clinical signs of infection depend on the ASFV strain(s) selected. Examples for such clinical signs include but are not limited to increased thirst, increased urination, weight loss, decreased appetite, lethargy, vomiting in the subject, viremia, fever, and shedding of the virus in the environment. However, the clinical signs also include but are not limited to clinical signs that are directly observable from a live animal.

Preferably, the clinical signs lessened in incidence or severity in a treated animal compared to animals that are either not treated or treated with an immunogenic composition that was available prior to the present invention but subsequently infected by the particular ASFV refer to African swine fever, acute African swine fever, chronic African swine fever, mortality, death, sudden death, fever, high fever, anorexia, lethargy, weakness, loss of appetite, recumbence, erythema, cyanotic skin blotching, diarrhea, constipation, abdominal pain, respiratory signs, coughing, vomiting, dyspnea, nasal and conjunctival discharges, hemorrhages, epistaxis, abortion, leukopenia, thrombocytopenia.

Herein, "effective dose" means, but is not limited to, an amount of antigen that elicits, or is able to elicit, an immune response that yields a reduction of clinical symptoms in an animal to which the antigen is administered.

As used herein, the term "effective amount" means, in the context of a composition, an amount of an immunogenic composition capable of inducing an immune response that reduces the incidence of or lessens the severity of infection or incident of disease in an animal. Such effective amount is able to lessen the incidence of the particular ASFV infection in porcine or to reduce the severity of clinical signs of the particular ASFV infection. Particularly, an effective amount refers to colony forming units (CFU) per dose. Alternatively, in the context of a therapy, the term "effective amount" refers to the amount of a therapy which is sufficient to reduce or ameliorate the severity or duration of a disease or disorder, or one or more symptoms thereof, prevent the advancement of a disease or disorder, cause the regression of a disease or disorder, prevent the recurrence, development, onset, or progression of one or more symptoms associated with a disease or disorder, or enhance or improve the prophylaxis or treatment of another therapy or therapeutic agent.

An "immune response" or "immunological response" or "immunogenicity" means, but is not limited to, the development of a cellular and/or antibody-mediated immune response to the (immunogenic) composition or vaccine of interest. Usually, an immune or immunological response or immunogenicity includes, but is not limited to, one or more of the following effects: the production or activation of antibodies, B cells, helper T cells, suppressor T cells, and/or cytotoxic T cells, directed specifically to an antigen or antigens included in the composition or vaccine of interest. Preferably, the host will display either a therapeutic or a protective immunological (memory) response such that resistance to new infection will be enhanced and/or the clinical severity of the disease will be reduced. Such protection will be demonstrated by either a reduction in number of symptoms, severity of symptoms, or the lack of one or more of the symptoms associated with the infection of the pathogen, a delay in the of onset of viremia, reduced viral persistence, a reduction in the overall viral load and/or a reduction of viral excretion.

In the course of the present invention an "immune response" or "immunological response" or "immunogenicity" is preferably indicated/characterized by an induced IFN-gamma response, more preferably in a porcine IFN-gamma ELISpot assay, more preferably in a porcine IFN-gamma ELISpot assay as described in Example 1. One exemplary porcine IFN-gamma ELISpot assay, which may be applied according to the present invention is as follows: IFNγ response is assessed by an ELISpot assay using purified mouse anti-pig IFNγ Clone P2G10 as capture antibody and biotinylated mouse anti-porcine IFNγ antibody P2C11 as detection antibody, following a previously reported method (Lacasta et al., 2014). Briefly, 96-well plates are coated overnight at 4° C. with 5 µg/ml capture antibody in carbonate-bicarbonate buffer, pH 9.6. Plates are washed 3× with PBS, and blocked 1 hour at 37° C. with complete RPMI with 10% FBS. $5\times10^5$ PBMCs/well are used in a final volume of 200 µl with the correspondent stimuli. Peptides and/or polypeptides, preferably full-length proteins, are added as a stimulus at a final concentration of 4 µg/ml. RPMI and 10 µg/ml phytohaemagglutinin-M are used as negative and positive controls, respectively. When the live attenuated virus BA71ΔCD2 is used as stimulus, $10^5$ PFU are added per well. After overnight incubation at 37° C., 5% $CO_2$, cells are washed out with PBS 0.05% Tween20, and IFNγ is detected using 0.5 µg/ml of biotinylated anti-porcine IFNγ antibody 1 hour at 37° C. After washing, the ELISpot is developed by adding 50 µl of insoluble 3,3',5,5'-tetramethylbenzidine (TMB) substrate and stopped by washing with water.

"Protection against disease", "protective immunity", "functional immunity", "reduction of clinical signs/symptoms", "induction/production of neutralizing antibodies and/or serum conversion", and similar phrases, means a partial or complete response against a disease or condition generated by administration of one or more immunogenic compositions or vaccines or pharmaceutical compositions of the invention, or a combination thereof, that results in fewer deleterious effects than would be expected in a non-immunized animal that has been exposed to disease or infection. That is, the severity of the deleterious effects of the infection is lessened in a vaccinated animal. Infection may be reduced, slowed, or possibly fully prevented, in a vaccinated animal Herein, where complete prevention of infection is meant, it is specifically stated. If complete prevention is not stated then the term includes partial prevention. A "protective immunological response" or "protective immunity" will be demonstrated by either a reduction or lack of clinical signs/symptoms normally displayed by an infected host, a quicker recovery time and/or a lowered duration of infectivity or lowered pathogen titer in the tissues or body fluids or excretions of the infected host.

Herein, "reduction of the incidence and/or severity of clinical signs" or "reduction of clinical symptoms" or "reducing or preventing the clinical signs or disease" means, but is not limited to, reducing the number of infected animals in a group, reducing or eliminating the number of animals exhibiting clinical signs of infection, or reducing the severity of any clinical signs that are present in one or more animals, in comparison to wild-type infection. For example, it should refer to any reduction of pathogen load, pathogen shedding, reduction in pathogen transmission, or reduction of any clinical sign symptomatic of ASFV infections. Preferably, these clinical signs/symptoms are reduced in one or more animals receiving the therapeutic composition of the present invention by at least 10% in comparison to animals not receiving the composition and that become infected. More preferably, clinical signs/symptoms are reduced in animals receiving a composition of the present invention by at least 20%, preferably by at least 30%, more preferably by at least 40%, and even more preferably by at least 50%.

The term "increased protection" herein means, but is not limited to, a statistically significant reduction of one or more clinical signs or symptoms, which are associated with infection by an infectious agent in a vaccinated group of animals vs. a non-vaccinated control group of animals. The term "statistically significant reduction of clinical symptoms" means, but is not limited to, the frequency in the incidence of at least one clinical symptom in the vaccinated group of animals is at least 10%, preferably 20%, more preferably 30%, even more preferably 50%, and even more preferably 70% lower than in the non-vaccinated control group after the challenge the infectious agent.

The term "pathogen" is well known to the person skilled in the art. The term "pathogen" comprises bacteria and viruses. In the course of the present invention, the term "pathogen infecting porcines" preferably is ASFV.

"Long-lasting protection" shall refer to "improved efficacy" that persists for at least 3 weeks, but more preferably at least 3 months, still more preferably at least 6 months.

The term "shedding" refers to secretions such as nasal discharges and, further, to aerosols created by coughing or sneezing. Thus, shedding may be determined by examining the virus titer in nasal swabs or by the virus titer in the lungs. The term "shedding" further encompasses the transfer of virus to susceptible animals (i e sentinels). It is in the general knowledge of a person skilled in the art how to measure the viral shedding.

"Safety" refers to the absence of adverse consequences in a vaccinated animal following vaccination, including but not limited to: potential reversion of a pathogen-based vaccine to virulence, clinically significant side effects such as persistent, systemic illness or unacceptable inflammation at the site of vaccine administration.

The terms "vaccination" or "vaccinating" or variants thereof, as used herein means, but is not limited to, a process which includes the administration of an immunogenic composition of the invention that, when administered to an animal, elicits, or is able to elicit—directly or indirectly—an immune response in said animal.

"Mortality", in the context of the present invention, refers to death caused by an infection, and includes the situation where the infection is so severe that an animal is euthanized to prevent suffering and provide a humane ending to its life.

The formulations of the invention comprise an effective immunizing amount of one or more immunogenic compositions and a physiologically acceptable vehicle. Vaccines comprise an effective immunizing amount of one or more immunogenic compositions and a physiologically acceptable vehicle. The formulation should suit the mode of administration.

The immunogenic composition, if desired, can also contain minor amounts of wetting or emulsifying agents, or pH buffering agents. The immunogenic composition can be a liquid solution, suspension, emulsion, tablet, pill, capsule, sustained release formulation, or powder. Oral formulation can include standard carriers such as pharmaceutical grades of mannitol, lactose, starch, magnesium stearate, sodium saccharine, cellulose, magnesium carbonate, etc.

Preferred routes of administration include but are not limited to intranasal, oral, intradermal, subcutaneous and intramuscular. Administration in drinking water, most preferably in a single dose, is desirable. The skilled artisan will recognize that compositions of the invention may also be administered in one, two or more doses, as well as, by other routes of administration. For example, such other routes include subcutaneously, intracutaneously, intraperitoneally, and depending on the desired duration and effectiveness of the treatment, the compositions according to the invention may be administered once or several times, also intermittently, for instance on a daily basis for several days, weeks or months and in different dosages such as about $1 \times 10^3$ to $1 \times 10^9$. In a specific aspect of the present invention, the dosage is about $1 \times 10^4$ to $1 \times 10^8$ $TCID_{50}$.

The term "sample" refers to a sample of a body fluid, to a sample of separated cells or to a sample from a tissue or an organ. Samples of body fluids can be obtained by well-known techniques and include, preferably, samples of blood, plasma, serum, or urine, more preferably, samples of blood, plasma or serum. Tissue or organ samples may be obtained from any tissue or organ by, e.g., biopsy. Separated cells may be obtained from the body fluids or the tissues or organs by separating techniques such as centrifugation or cell sorting.

The term "obtained" may comprise an isolation and/or purification step known to the person skilled in the art, preferably using precipitation, columns etc.

The term "immunotest" and "genomic analytical test" is the basis for differentiating animals vaccinated with the immunogenic composition according to the present invention and animals infected with the naturally occurring (disease-associated) ASFV. Examples of immunotests include any enzyme-immunological or immunochemical detection method such as ELISA (enzyme linked immunosorbent assay), EIA (enzyme immunoassay), RIA (radioimmunoassay), sandwich enzyme immune tests, fluorescent antibody test (FAT) electrochemiluminescence sandwich immunoassays (ECLIA), dissociation-enhanced lanthanide fluoro immuno assay (DELFIA) or solid phase immune tests, immunofluorescent test (IFT), immunohistological staining, Western blot analysis or any other suitable method available to technicians skilled in the art. Depending upon the assay used, the antigens or the antibodies can be labeled by an enzyme, a fluorophore or a radioisotope. See, e.g., Coligan et al. Current Protocols in Immunology, John Wiley & Sons Inc., New York, N.Y. (1994); and Frye et al., Oncogen 4: 1153-1157, 1987.

The term "genomic analytical test" refers to a genomic analytical method based upon the polymerase chain reaction (PCR), reverse transcription polymerase chain reaction (RT-PCR), real-time PCR (r-PCR) or real time reverse transcription PCR (rRT-PCR), Templex-PCR, nucleic-acid sequence based amplification (NASBA), and isothermal amplification methods using polymerases and specific oligonucleotides as primers. The aforementioned amplification methods are well known in the art.

Hybridization reactions can be performed under conditions of different "stringency." Conditions that increase stringency of a hybridization reaction are well known. See for examples, "Molecular Cloning: A Laboratory Manual", second edition (Sambrook et al. 1989). Examples of relevant conditions include (in order of increasing stringency): incubation temperatures of 25° C., 37° C., 50° C., and 68° C.; buffer concentrations of 10×SSC, 6×SSC, 1×SSC, 0.1×SSC (where SSC is 0.15 M NaCl and 15 mM citrate buffer) and their equivalent using other buffer systems; formamide concentrations of 0%, 25%, 50%, and 75%; incubation times from 5 minutes to 24 hours; 1, 2 or more washing steps; wash incubation times of 1, 2, or 15 minutes; and wash solutions of 6×SSC, 1×SSC, 0.1×SSC, or deionized water.

The term "epitope" refers to the site on an antigen, such as an ASFV peptide, polypeptide or full-length protein as well as an ASFV oligonucleotide or polynucleotide according to the present invention, to which specific B cells and/or T cells respond. The term is also used interchangeably with "antigenic determinant" or "antigenic determinant site". Antibodies that recognize the same epitope can be identified in a simple immunoassay showing the ability of one antibody to block the binding of another antibody to a target antigen.

SEQUENCE LISTING

This application contains a sequence listing. The sequence listing comprises the following sequences, which are either amino acid sequences (N-terminus to C-terminus direction) or DNA sequences (5"-end to 3'-end direction):

SEQ ID NO: 1 A18R peptide Georgia 2007/1, 23-43, 21
SEQ ID NO: 2 A118R peptide Georgia 2007/1, 33-43, 11
SEQ ID NO: 3 A118R peptide Georgia 2007/1, 41-50, 10
SEQ ID NO: 4 A118R protein Georgia 2007/1
SEQ ID NO: 5 A137R peptide BA71
SEQ ID NO: 6 A137R protein BA71
SEQ ID NO: 7 A137R protein Georgia2007/1
SEQ ID NO: 8 A151R peptide BA71
SEQ ID NO: 9 A151R peptide Georgia 2007/1, 40-55, 16
SEQ ID NO: 10 A151R peptide Georgia 2007/1, 43-52, 10
SEQ ID NO: 11 A151R peptide Georgia 2007/1, 48-55, 8
SEQ ID NO: 12 A151R protein BA71
SEQ ID NO: 13 A151R protein Georgia 2007/1
SEQ ID NO: 14 A179L peptide BA71
SEQ ID NO: 15 A179L protein BA71
SEQ ID NO: 16 A179L protein Georgia 2007/1
SEQ ID NO: 17 A238L peptide BA71
SEQ ID NO: 18 A238L peptide BA71
SEQ ID NO: 19 A238L peptide Georgia 2007/1
SEQ ID NO: 20 A238L peptide Georgia 2007/1
SEQ ID NO: 21 A238L protein BA71
SEQ ID NO: 22 A238L protein BA71
SEQ ID NO: 23 A238L protein Georgia 2007/1

SEQ ID NO: 24 A238L protein Georgia 2007/1
SEQ ID NO: 25 A240L peptide Georgia 2007/1
SEQ ID NO: 26 A240L peptide Georgia 2007/1
SEQ ID NO: 27 A240L protein Georgia 2007/1
SEQ ID NO: 28 A859L peptide Georgia 2007/1, 572-580, 9
SEQ ID NO: 29 A859L peptide Georgia 2007/1, 626-636, 11
SEQ ID NO: 30 A859L protein Georgia 2007/1
SEQ ID NO: 31 B117L peptide BA71
SEQ ID NO: 32 B117L protein BA71
SEQ ID NO: 33 B117L protein Georgia 2007/1
SEQ ID NO: 34 B119L peptide Georgia 2007/1, 68-75, 8
SEQ ID NO: 35 B119L protein Georgia 2007/1
SEQ ID NO: 36 B125R peptide BA71
SEQ ID NO: 37 B125R peptide BA71
SEQ ID NO: 38 B125R protein BA71
SEQ ID NO: 39 B125R protein Georgia 2007/1
SEQ ID NO: 40 B169L peptide Georgia 2007/1, 26-34, 9
SEQ ID NO: 41 B169L protein Georgia 2007/1
SEQ ID NO: 42 B175L peptide Georgia 2007/1, 69-78, 10
SEQ ID NO: 43 B175L protein Georgia 2007/1
SEQ ID NO: 44 B318L peptide Georgia 2007/1, 155-162, 8
SEQ ID NO: 45 B318L protein Georgia 2007/1
SEQ ID NO: 46 B385R peptide Georgia 2007/1, 180-188, 9
SEQ ID NO: 47 B385R protein Georgia 2007/1
SEQ ID NO: 48 B475L peptide BA71
SEQ ID NO: 49 B475L peptide BA71
SEQ ID NO: 50 B475L peptide BA71
SEQ ID NO: 51 B475L peptide BA71
SEQ ID NO: 52 B475L peptide BA71
SEQ ID NO: 53 B475L peptide BA71
SEQ ID NO: 54 B475L peptide Georgia 2007/1
SEQ ID NO: 55 B475L peptide Georgia 2007/1
SEQ ID NO: 56 B475L peptide Georgia 2007/1
SEQ ID NO: 57 B475L peptide Georgia 2007/1
SEQ ID NO: 58 B475L peptide Georgia 2007/1
SEQ ID NO: 59 B475L peptide Georgia 2007/1
SEQ ID NO: 60 B475L peptide Georgia 2007/1, 10-18, 9
SEQ ID NO: 61 B475L peptide Georgia 2007/1, 14-24, 11
SEQ ID NO: 62 B475L peptide Georgia 2007/1, 14-28, 15
SEQ ID NO: 63 B475L peptide Georgia 2007/1, 18-28, 11
SEQ ID NO: 64 B475L peptide Georgia 2007/1, 62-70, 9
SEQ ID NO: 65 B475L protein BA71
SEQ ID NO: 66 B475L protein Georgia 2007/1
SEQ ID NO: 67 B602L peptide BA71
SEQ ID NO: 68 B602L peptide BA71
SEQ ID NO: 69 B602L peptide BA71
SEQ ID NO: 70 B602L peptide Georgia 2007/1, 54-77, 24
SEQ ID NO: 71 B602L peptide Georgia 2007/1, 61-69, 9
SEQ ID NO: 72 B602L peptide Georgia 2007/1, 61-71, 11
SEQ ID NO: 73 B602L peptide Georgia 2007/1, 73-81, 9
SEQ ID NO: 74 B602L protein BA71
SEQ ID NO: 75 B602L protein Georgia 2007/1
SEQ ID NO: 76 B646L peptide BA71
SEQ ID NO: 77 B646L peptide BA71
SEQ ID NO: 78 B646L peptide BA71
SEQ ID NO: 79 B646L peptide BA71
SEQ ID NO: 80 B646L peptide Georgia 2007/1, 455-465, 11
SEQ ID NO: 81 B646L peptide Georgia 2007/1, 457-465, 9
SEQ ID NO: 82 B646L protein BA71
SEQ ID NO: 83 B646L protein Georgia2007/1
SEQ ID NO: 84 B962L peptide Georgia 2007/1, 599-606, 8
SEQ ID NO: 85 B962L protein Georgia 2007/1
SEQ ID NO: 86 BA71V-A104R protein BA71
SEQ ID NO: 87 BA71V-A104R protein Georgia2007/1
SEQ ID NO: 88 BA71V-A118R protein BA71
SEQ ID NO: 89 BA71V-A118R protein Georgia2007/1
SEQ ID NO: 90 BA71V-A137R(p11.5) protein BA71
SEQ ID NO: 91 BA71V-A137R(p11.5) protein Georgia2007/1
SEQ ID NO: 92 BA71V-A179L(5HL)Bcl2 protein BA71
SEQ ID NO: 93 BA71V-A179L(5HL)Bcl2 protein Georgia2007/1
SEQ ID NO: 94 BA71V-A224L(4CL) protein BA71
SEQ ID NO: 95 BA71V-A224L(4CL) protein Georgia2007/1
SEQ ID NO: 96 BA71V-A238L(5EL) protein BA71
SEQ ID NO: 97 BA71V-A238L(5EL) protein Georgia2007/1
SEQ ID NO: 98 BA71V-A859L protein BA71
SEQ ID NO: 99 BA71V-A859L protein Georgia2007/1
SEQ ID NO: 100 BA71V-B175L protein BA71
SEQ ID NO: 101 BA71V-B175L protein Georgia2007/1
SEQ ID NO: 102 BA71V-B263R protein BA71
SEQ ID NO: 103 BA71V-B263R protein Georgia2007/1
SEQ ID NO: 104 BA71V-B407L protein BA71
SEQ ID NO: 105 BA71V-B407L protein Georgia2007/1
SEQ ID NO: 106 BA71V-B438L(p49) protein BA71
SEQ ID NO: 107 BA71V-B438L(p49) protein Georgia2007/1
SEQ ID NO: 108 BA71V-C62L protein BA71
SEQ ID NO: 109 BA71V-C62L protein Georgia2007/1
SEQ ID NO: 110 BA71V-D129L protein BA71
SEQ ID NO: 111 BA71V-D129L protein Georgia2007/1
SEQ ID NO: 112 BA71V-D250R(g5R) protein BA71
SEQ ID NO: 113 BA71V-D250R(g5R) protein Georgia2007/1
SEQ ID NO: 114 BA71V-D345L(i3L,i4L) protein BA71
SEQ ID NO: 115 BA71V-D345L(i3L,i4L) protein Georgia2007/1
SEQ ID NO: 116 BA71V-D79L(g7L) protein BA71
SEQ ID NO: 117 BA71V-D79L(g7L) protein Georgia2007/1
SEQ ID NO: 118 BA71V-DP96R protein BA71
SEQ ID NO: 119 BA71V-DP96R protein Georgia2007/1
SEQ ID NO: 120 BA71V-E111R(k6R) protein BA71
SEQ ID NO: 121 BA71V-E111R(k6R) protein Georgia2007/1
SEQ ID NO: 122 BA71V-E120R(p14.5) protein BA71
SEQ ID NO: 123 BA71V-E120R(p14.5) protein Georgia2007/1
SEQ ID NO: 124 BA71V-E165R(k1R) protein BA71
SEQ ID NO: 125 BA71V-E165R(k1R) protein Georgia2007/1
SEQ ID NO: 126 BA71V-E183L(p54,j13L) protein BA71
SEQ ID NO: 127 BA71V-E183L(p54j13L) protein Georgia2007/1
SEQ ID NO: 128 BA71V-E184L(j12L) protein BA71
SEQ ID NO: 129 BA71V-E184L(j12L) protein Georgia2007/1
SEQ ID NO: 130 BA71V-E199L(j18L) protein BA71
SEQ ID NO: 131 BA71V-E199L(j18L) protein Georgia2007/1
SEQ ID NO: 132 BA71V-E248R(k2R) protein BA71
SEQ ID NO: 133 BA71V-E248R(k2R) protein Georgia2007/1
SEQ ID NO: 134 BA71V-E296R(k4R) protein BA71

SEQ ID NO: 135 BA71V-E296R(k4R) protein Georgia2007/1
SEQ ID NO: 136 BA71V-E301R(j15R) protein BA71
SEQ ID NO: 137 BA71V-E301R(j15R) protein Georgia2007/1
SEQ ID NO: 138 BA71V-EP152R protein BA71
SEQ ID NO: 139 BA71V-EP152R protein Georgia2007/1
SEQ ID NO: 140 BA71V-EP364R protein BA71
SEQ ID NO: 141 BA71V-EP364R protein Georgia2007/1
SEQ ID NO: 142 BA71V-F165R protein BA71
SEQ ID NO: 143 BA71V-F165R protein Georgia2007/1
SEQ ID NO: 144 BA71V-F317L protein BA71
SEQ ID NO: 145 BA71V-F317L protein Georgia2007/1
SEQ ID NO: 146 BA71V-H124R protein BA71
SEQ ID NO: 147 BA71V-H124R protein Georgia2007/1
SEQ ID NO: 148 BA71V-H171R(j2R) protein BA7
SEQ ID NO: 149 BA71V-H171R(j2R) protein Georgia2007/1
SEQ ID NO: 150 BA71V-H359L(j1L) protein BA71
SEQ ID NO: 151 BA71V-H359L(j1L) protein Georgia2007/1
SEQ ID NO: 152 BA71V-I177L(k14L) protein BA71
SEQ ID NO: 153 BA71V-I177L(k14L) protein Georgia2007/1
SEQ ID NO: 154 BA71V-I196L(k15L) protein BA71
SEQ ID NO: 155 BA71V-I196L(k15L) protein Georgia2007/1
SEQ ID NO: 156 BA71V-I215L(k13L) protein BA71
SEQ ID NO: 157 BA71V-I215L(k13L) protein Georgia2007/1
SEQ ID NO: 158 BA71V-I267L(k7L) protein BA71
SEQ ID NO: 159 BA71V-I267L(k7L) protein Georgia2007/
SEQ ID NO: 160 BA71V-K205R protein BA71
SEQ ID NO: 161 BA71V-K205R protein Georgia2007/1
SEQ ID NO: 162 BA71V-K78R(p10) protein BA71
SEQ ID NO: 163 BA71V-K78R(p10) protein Georgia2007/1
SEQ ID NO: 164 BA71V-KP177R protein BA71
SEQ ID NO: 165 BA71V-KP177R protein Georgia2007/1
SEQ ID NO: 166 BA71V-O174L protein BA71
SEQ ID NO: 167 BA71V-O174L protein Georgia2007/1
SEQ ID NO: 168 BA71V-S183(i5L) protein BA71
SEQ ID NO: 169 BA71V-S183(i5L) protein Georgia2007/1
SEQ ID NO: 170 BA71V-S273R(i6R) protein BA71
SEQ ID NO: 171 BA71V-S273R(i6R) protein Georgia2007/1
SEQ ID NO: 172 BA71V-X69R protein BA71
SEQ ID NO: 173 BA71V-X69R protein Georgia2007/1
SEQ ID NO: 174 C129R peptide BA71
SEQ ID NO: 175 C129R peptide BA71
SEQ ID NO: 176 C129R protein BA71
SEQ ID NO: 177 C129R protein Georgia2007/1
SEQ ID NO: 178 C147L peptide Georgia 2007/1, 10-18, 9
SEQ ID NO: 179 C147L protein Georgia 2007/1
SEQ ID NO: 180 C257L peptide BA71
SEQ ID NO: 181 C257L protein BA71
SEQ ID NO: 182 C257L protein Georgia2007/1
SEQ ID NO: 183 C315R peptide BA71
SEQ ID NO: 184 C315R peptide Georgia 2007/1, 257-267, 11
SEQ ID NO: 185 C315R peptide Georgia 2007/1, 290-299, 10
SEQ ID NO: 186 C315R protein BA71
SEQ ID NO: 187 C315R protein Georgia 2007/1
SEQ ID NO: 188 C475L peptide BA71
SEQ ID NO: 189 C475L peptide BA71
SEQ ID NO: 190 C475L peptide BA71
SEQ ID NO: 191 C475L peptide BA71
SEQ ID NO: 192 C475L peptide Georgia 2007/1, 115-123, 9
SEQ ID NO: 193 C475L peptide Georgia 2007/1, 127-137, 11
SEQ ID NO: 194 C475L peptide Georgia 2007/1, 130-137, 8
SEQ ID NO: 195 C475L peptide Georgia 2007/1, 207-217, 11
SEQ ID NO: 196 C475L peptide Georgia 2007/1, 207-221, 15
SEQ ID NO: 197 C475L peptide Georgia 2007/1, 210-217, 8
SEQ ID NO: 198 C475L peptide Georgia 2007/1, 213-221, 9
SEQ ID NO: 199 C475L peptide Georgia 2007/1, 438-445, 8
SEQ ID NO: 200 C475L protein BA71
SEQ ID NO: 201 C475L protein Georgia 2007/1
SEQ ID NO: 202 C62L peptide Georgia 2007/1, 33-51, 19
SEQ ID NO: 203 C62L peptide Georgia 2007/1, 41-51, 11
SEQ ID NO: 204 C62L protein Georgia 2007/1
SEQ ID NO: 205 C62L protein Georgia 2007/1
SEQ ID NO: 206 C717R peptide Georgia 2007/1, 104-116, 13
SEQ ID NO: 207 C717R peptide Georgia 2007/1, 356-363, 8
SEQ ID NO: 208 C717R peptide Georgia 2007/1, 356-366, 11
SEQ ID NO: 209 C717R peptide Georgia 2007/1, 388-407, 20
SEQ ID NO: 210 C717R peptide Georgia 2007/1, 394-404, 11
SEQ ID NO: 211 C717R peptide Georgia 2007/1, 425-435, 11
SEQ ID NO: 212 C717R peptide Georgia 2007/1, 47-62, 16
SEQ ID NO: 213 C717R peptide Georgia 2007/1, 495-505, 11
SEQ ID NO: 214 C717R peptide Georgia 2007/1, 543-553, 11
SEQ ID NO: 215 C717R peptide Georgia 2007/1, 543-563, 21
SEQ ID NO: 216 C717R peptide Georgia 2007/1, 546-553, 8
SEQ ID NO: 217 C717R protein Georgia 2007/1
SEQ ID NO: 218 C84L peptide Georgia 2007/1, 42-49, 8
SEQ ID NO: 219 C84L protein Georgia 2007/1
SEQ ID NO: 220 C962R peptide Georgia 2007/1, 327-335, 9
SEQ ID NO: 221 C962R peptide Georgia 2007/1, 398-407, 10
SEQ ID NO: 222 C962R peptide Georgia 2007/1, 398-417, 20
SEQ ID NO: 223 C962R peptide Georgia 2007/1, 400-409, 10
SEQ ID NO: 224 C962R peptide Georgia 2007/1, 407-416, 10
SEQ ID NO: 225 C962R peptide Georgia 2007/1, 536-544, 9
SEQ ID NO: 226 C962R peptide Georgia 2007/1, 726-742, 17
SEQ ID NO: 227 C962R peptide Georgia 2007/1, 730-738, 9

SEQ ID NO: 228 C962R protein Georgia 2007/1
SEQ ID NO: 229 CP123L peptide BA71
SEQ ID NO: 230 CP123L peptide BA71
SEQ ID NO: 231 CP123L protein BA71
SEQ ID NO: 232 CP123L protein Georgia2007/1
SEQ ID NO: 233 CP204L peptide Georgia 2007/1, 23-33, 11
SEQ ID NO: 234 CP204L protein Georgia 2007/1
SEQ ID NO: 235 CP2475L peptide BA71
SEQ ID NO: 236 CP2475L peptide BA71
SEQ ID NO: 237 CP2475L peptide BA71
SEQ ID NO: 238 CP2475L peptide BA71
SEQ ID NO: 239 CP2475L peptide BA71
SEQ ID NO: 240 CP2475L peptide BA71
SEQ ID NO: 241 CP2475L peptide BA71
SEQ ID NO: 242 CP2475L peptide BA71
SEQ ID NO: 243 CP2475L peptide BA71
SEQ ID NO: 244 CP2475L peptide Georgia 2007/1, 1540-1562, 23
SEQ ID NO: 245 CP2475L peptide Georgia 2007/1, 1547-1557, 11
SEQ ID NO: 246 CP2475L peptide Georgia 2007/1, 1795-1807, 13
SEQ ID NO: 247 CP2475L peptide Georgia 2007/1, 1889-1898, 10
SEQ ID NO: 248 CP2475L peptide Georgia 2007/1, 2019-2029, 11
SEQ ID NO: 249 CP2475L peptide Georgia 2007/1, 214-221, 8
SEQ ID NO: 250 CP2475L peptide Georgia 2007/1, 2226-2234, 9
SEQ ID NO: 251 CP2475L peptide Georgia 2007/1, 538-559, 22
SEQ ID NO: 252 CP2475L peptide Georgia 2007/1, 543-551, 9
SEQ ID NO: 253 CP2475L peptide Georgia 2007/1, 544-554, 11
SEQ ID NO: 254 CP2475L peptide Georgia 2007/1, 549-559, 11
SEQ ID NO: 255 CP2475L peptide Georgia 2007/1, 976-985, 10
SEQ ID NO: 256 CP2475L protein BA71
SEQ ID NO: 257 CP2475L protein Georgia 2007/1
SEQ ID NO: 258 CP2475L_P150 peptide Georgia 2007/1
SEQ ID NO: 259 CP2475L_P150 peptide Georgia 2007/1
SEQ ID NO: 260 CP2475L_P150 peptide Georgia 2007/1
SEQ ID NO: 261 CP2475L_P37 peptide Georgia 2007/1
SEQ ID NO: 262 CP2475L_P37 peptide Georgia 2007/1
SEQ ID NO: 263 CP2475L_P37 peptide Georgia 2007/1
SEQ ID NO: 264 CP2475L_P37 peptide Georgia 2007/1
SEQ ID NO: 265 CP2475L_P37 peptide Georgia 2007/1
SEQ ID NO: 266 CP2475L_P37 peptide Georgia 2007/1
SEQ ID NO: 267 CP312R peptide BA71
SEQ ID NO: 268 CP312R peptide Georgia 2007/1
SEQ ID NO: 269 CP312R peptide Georgia 2007/1
SEQ ID NO: 270 CP312R peptide Georgia 2007/1
SEQ ID NO: 271 CP312R peptide Georgia 2007/1
SEQ ID NO: 272 CP312R protein BA71
SEQ ID NO: 273 CP312R protein Georgia 2007/1
SEQ ID NO: 274 CP312R protein Georgia2007/1
SEQ ID NO: 275 CP530R peptide Georgia 2007/1, 225-235, 11
SEQ ID NO: 276 CP530R peptide Georgia 2007/1, 232-241, 10
SEQ ID NO: 277 CP530R peptide Georgia 2007/1, 358-365, 8
SEQ ID NO: 278 CP530R protein Georgia 2007/1
SEQ ID NO: 279 CP80R peptide Georgia 2007/1, 67-76, 10
SEQ ID NO: 280 CP80R protein Georgia 2007/1
SEQ ID NO: 281 D1133L peptide BA71
SEQ ID NO: 282 D1133L peptide BA71
SEQ ID NO: 283 D1133L peptide BA71
SEQ ID NO: 284 D1133L peptide BA71
SEQ ID NO: 285 D1133L peptide BA71
SEQ ID NO: 286 D1133L peptide BA71
SEQ ID NO: 287 D1133L peptide Georgia 2007/1
SEQ ID NO: 288 D1133L peptide Georgia 2007/1
SEQ ID NO: 289 D1133L peptide Georgia 2007/1, 1000-1008, 9
SEQ ID NO: 290 D1133L peptide Georgia 2007/1, 1111-1120, 10
SEQ ID NO: 291 D1133L peptide Georgia 2007/1, 114-124, 11
SEQ ID NO: 292 D1133L peptide Georgia 2007/1, 756-766, 11
SEQ ID NO: 293 D1133L peptide Georgia 2007/1, 782-790, 9
SEQ ID NO: 294 D1133L peptide Georgia 2007/1, 819-827, 9
SEQ ID NO: 295 D1133L protein BA71
SEQ ID NO: 296 D1133L protein BA71
SEQ ID NO: 297 D1133L protein Georgia 2007/1
SEQ ID NO: 298 D1133L protein Georgia2007/1
SEQ ID NO: 299 D133L peptide Georgia 2007/1
SEQ ID NO: 300 D133L peptide Georgia 2007/1
SEQ ID NO: 301 D133L peptide Georgia 2007/1
SEQ ID NO: 302 D133L peptide Georgia 2007/1
SEQ ID NO: 303 D205R peptide BA71
SEQ ID NO: 304 D205R peptide BA71
SEQ ID NO: 305 D205R peptide BA71
SEQ ID NO: 306 D205R peptide Georgia 2007/1, 1-19, 19
SEQ ID NO: 307 D205R peptide Georgia 2007/1, 2-11, 10
SEQ ID NO: 308 D205R peptide Georgia 2007/1, 5-13, 9
SEQ ID NO: 309 D205R peptide Georgia 2007/1, 7-17, 11
SEQ ID NO: 310 D205R peptide Georgia 2007/1, 9-16, 8
SEQ ID NO: 311 D205R protein BA71
SEQ ID NO: 312 D205R protein Georgia 2007/1
SEQ ID NO: 313 D250R peptide BA71
SEQ ID NO: 314 D250R peptide Georgia 2007/1, 168-178, 11
SEQ ID NO: 315 D250R peptide Georgia 2007/1, 176-184, 9
SEQ ID NO: 316 D250R peptide Georgia 2007/1, 32-48, 17
SEQ ID NO: 317 D250R peptide Georgia 2007/1, 3-46, 10
SEQ ID NO: 318 D250R protein BA71
SEQ ID NO: 319 D250R protein Georgia2007/1
SEQ ID NO: 320 D339L peptide BA71
SEQ ID NO: 321 D339L protein BA71
SEQ ID NO: 322 D339L protein Georgia2007/1
SEQ ID NO: 323 D345L peptide Georgia 2007/1, 125-133, 9
SEQ ID NO: 324 D345L protein Georgia 2007/1
SEQ ID NO: 325 DP238L peptide BA71
SEQ ID NO: 326 DP238L protein BA71
SEQ ID NO: 327 DP238L protein Georgia2007/1
SEQ ID NO: 328 DP96R peptide Georgia 2007/1, 46-55, 10
SEQ ID NO: 329 DP96R protein Georgia 2007/1

SEQ ID NO: 330 E111R peptide BA71
SEQ ID NO: 331 E111R protein BA71
SEQ ID NO: 332 E111R protein Georgia2007/1
SEQ ID NO: 333 E120R peptide BA71
SEQ ID NO: 334 E120R protein BA71
SEQ ID NO: 335 E120R protein Georgia2007/1
SEQ ID NO: 336 E146L peptide Georgia 2007/1, 52-64, 13
SEQ ID NO: 337 E146L peptide Georgia 2007/1, 55-64, 10
SEQ ID NO: 338 E146L protein Georgia 2007/1
SEQ ID NO: 339 E146L protein Georgia 2007/1
SEQ ID NO: 340 E183L peptide BA71
SEQ ID NO: 341 E183L protein BA71
SEQ ID NO: 342 E183L protein Georgia2007/1
SEQ ID NO: 343 E248R peptide BA71
SEQ ID NO: 344 E248R protein BA71
SEQ ID NO: 345 E248R protein Georgia2007/1
SEQ ID NO: 346 E301R peptide BA71
SEQ ID NO: 347 E301R peptide Georgia 2007/1, 290-297 8
SEQ ID NO: 348 E301R protein BA71
SEQ ID NO: 349 E301R protein Georgia2007/1
SEQ ID NO: 350 E423R peptide Georgia 2007/1, 152-169, 18
SEQ ID NO: 351 E423R peptide Georgia 2007/1, 57-64, 8
SEQ ID NO: 352 E423R protein Georgia 2007/1
SEQ ID NO: 353 E66L peptide Georgia 2007/1, 18-27, 10
SEQ ID NO: 354 E66L peptide Georgia 2007/1, 4-13, 10
SEQ ID NO: 355 E66L protein BA71
SEQ ID NO: 356 E66L protein Georgia2007/1
SEQ ID NO: 357 EP1242L peptide BA71
SEQ ID NO: 358 EP1242L peptide BA71
SEQ ID NO: 359 EP1242L peptide Georgia 2007/1, 61-69, 9
SEQ ID NO: 360 EP1242L peptide Georgia 2007/1, 818-828, 11
SEQ ID NO: 361 EP1242L protein BA71
SEQ ID NO: 362 EP1242L protein Georgia 2007/1
SEQ ID NO: 363 EP152R peptide Georgia 2007/1, 40-60, 21
SEQ ID NO: 364 EP152R protein Georgia 2007/1
SEQ ID NO: 365 EP153R peptide Georgia 2007/1, 116-124, 9
SEQ ID NO: 366 EP153R protein Georgia 2007/1
SEQ ID NO: 367 EP296R peptide Georgia 2007/1, 235-245, 11
SEQ ID NO: 368 EP296R protein Georgia 2007/1
SEQ ID NO: 369 EP364R peptide BA71
SEQ ID NO: 370 EP364R protein BA71
SEQ ID NO: 371 EP364R protein Georgia2007/1
SEQ ID NO: 372 EP402R peptide Georgia 2007/1, 150-158, 9
SEQ ID NO: 373 EP402R peptide Georgia 2007/1, 189-210, 22
SEQ ID NO: 374 EP402R peptide Georgia 2007/1, 190-200, 11
SEQ ID NO: 375 EP402R peptide Georgia 2007/1, 192-202, 11
SEQ ID NO: 376 EP402R peptide Georgia 2007/1, 196-206, 11
SEQ ID NO: 377 EP402R peptide Georgia 2007/1, 279-287, 9
SEQ ID NO: 378 EP402R protein Georgia 2007/1
SEQ ID NO: 379 EP424R peptide BA71
SEQ ID NO: 380 EP424R peptide BA71
SEQ ID NO: 381 EP424R peptide Georgia 2007/1
SEQ ID NO: 382 EP424R peptide Georgia 2007/1
SEQ ID NO: 383 EP424R peptide Georgia 2007/1, 137-146, 10
SEQ ID NO: 384 EP424R peptide Georgia 2007/1, 140-156, 17
SEQ ID NO: 385 EP424R peptide Georgia 2007/1, 146-154, 9
SEQ ID NO: 386 EP424R peptide Georgia 2007/1, 215-225, 11
SEQ ID NO: 387 EP424R peptide Georgia 2007/1, 270-278, 9
SEQ ID NO: 388 EP424R protein BA71
SEQ ID NO: 389 EP424R protein Georgia2007/1
SEQ ID NO: 390 F1055L peptide Georgia 2007/1, 111-127, 17
SEQ ID NO: 391 F1055L peptide Georgia 2007/1, 112-121, 10
SEQ ID NO: 392 F1055L peptide Georgia 2007/1, 116-125, 10
SEQ ID NO: 393 F1055L peptide Georgia 2007/1, 527-535, 9
SEQ ID NO: 394 F1055L peptide Georgia 2007/1, 905-923, 19
SEQ ID NO: 395 F1055L protein Georgia 2007/1
SEQ ID NO: 396 F165R peptide Georgia 2007/1, 14-36, 23
SEQ ID NO: 397 F165R peptide Georgia 2007/1, 23-32, 10
SEQ ID NO: 398 F165R protein Georgia 2007/1
SEQ ID NO: 399 F317L peptide BA71
SEQ ID NO: 400 F317L peptide BA71
SEQ ID NO: 401 F317L peptide Georgia 2007/1, 246-256, 11
SEQ ID NO: 402 F317L peptide Georgia 2007/1, 248-256, 9
SEQ ID NO: 403 F317L peptide Georgia 2007/1, 4-13, 10
SEQ ID NO: 404 F317L protein BA71
SEQ ID NO: 405 F317L protein Georgia2007/1
SEQ ID NO: 406 F334L peptide BA71
SEQ ID NO: 407 F334L peptide Georgia 2007/1, 264-274, 11
SEQ ID NO: 408 F334L protein BA71
SEQ ID NO: 409 F334L protein Georgia 2007/1
SEQ ID NO: 410 F778R peptide Georgia 2007/1, 520-530, 11
SEQ ID NO: 411 F778R peptide Georgia 2007/1, 711-723, 13
SEQ ID NO: 412 F778R peptide Georgia 2007/1, 712-720, 9
SEQ ID NO: 413 F778R peptide Georgia 2007/1, 713-723, 11
SEQ ID NO: 414 F778R peptide Georgia 2007/1, 715-723, 9
SEQ ID NO: 415 F778R protein Georgia 2007/1
SEQ ID NO: 416 G1211R peptide BA71
SEQ ID NO: 417 G1211R peptide BA71
SEQ ID NO: 418 G1211R peptide BA71
SEQ ID NO: 419 G1211R peptide BA71
SEQ ID NO: 420 G1211R peptide Georgia 2007/1
SEQ ID NO: 421 G1211R peptide Georgia 2007/1
SEQ ID NO: 422 G1211R peptide Georgia 2007/1
SEQ ID NO: 423 G1211R peptide Georgia 2007/1
SEQ ID NO: 424 G1211R peptide Georgia 2007/1, 1043-1050, 8
SEQ ID NO: 425 G1211R peptide Georgia 2007/1, 146-157, 12

SEQ ID NO: 426 G1211R peptide Georgia 2007/1, 147-155, 9
SEQ ID NO: 427 G1211R peptide Georgia 2007/1, 206-215, 10
SEQ ID NO: 428 G1211R peptide Georgia 2007/1, 519-529, 11
SEQ ID NO: 429 G1211R peptide Georgia 2007/1, 698-707, 10
SEQ ID NO: 430 G1211R protein BA71
SEQ ID NO: 431 G1211R protein BA71
SEQ ID NO: 432 G1211R protein Georgia2007/1
SEQ ID NO: 433 G1211R protein Georgia2007/1
SEQ ID NO: 434 G1340L peptide BA71
SEQ ID NO: 435 G1340L peptide Georgia 2007/1, 229-236, 8
SEQ ID NO: 436 G1340L peptide Georgia 2007/1, 456-476, 21
SEQ ID NO: 437 G1340L peptide Georgia 2007/1, 463-473, 11
SEQ ID NO: 438 G1340L peptide Georgia 2007/1, 466-473, 8
SEQ ID NO: 439 G1340L peptide Georgia 2007/1, 534-550, 17
SEQ ID NO: 440 G1340L peptide Georgia 2007/1, 538-546, 9
SEQ ID NO: 441 G1340L peptide Georgia 2007/1, 540-548, 9
SEQ ID NO: 442 G1340L peptide Georgia 2007/1, 97-106, 10
SEQ ID NO: 443 G1340L protein BA71
SEQ ID NO: 444 G1340L protein Georgia 2007/1
SEQ ID NO: 445 H124R peptide Georgia 2007/1, 51-61, 11
SEQ ID NO: 446 H124R peptide Georgia 2007/1, 52-61, 10
SEQ ID NO: 447 H124R protein Georgia 2007/1
SEQ ID NO: 448 H233R peptide BA71
SEQ ID NO: 449 H233R peptide BA71
SEQ ID NO: 450 H233R protein BA71
SEQ ID NO: 451 H233R protein Georgia2007/1
SEQ ID NO: 452 H240R peptide Georgia 2007/1, 139-148 10
SEQ ID NO: 453 H240R protein Georgia 2007/1
SEQ ID NO: 454 H339R peptide BA71
SEQ ID NO: 455 H339R peptide BA71
SEQ ID NO: 456 H339R peptide BA71
SEQ ID NO: 457 H339R peptide BA71
SEQ ID NO: 458 H339R peptide Georgia 2007/1
SEQ ID NO: 459 H339R peptide Georgia 2007/1
SEQ ID NO: 460 H339R peptide Georgia 2007/1
SEQ ID NO: 461 H339R peptide Georgia 2007/1
SEQ ID NO: 462 H339R peptide Georgia 2007/1
SEQ ID NO: 463 H339R peptide Georgia 2007/1, 200-209, 10
SEQ ID NO: 464 H339R peptide Georgia 2007/1, 84-92, 9
SEQ ID NO: 465 H339R peptide Georgia 2007/1, 87-95, 9
SEQ ID NO: 466 H339R protein BA71
SEQ ID NO: 467 H339R protein BA71
SEQ ID NO: 468 H339R protein Georgia2007/1
SEQ ID NO: 469 H339R protein Georgia2007/1
SEQ ID NO: 470 H359L peptide BA71
SEQ ID NO: 471 H359L protein BA71
SEQ ID NO: 472 H359L protein Georgia2007/1
SEQ ID NO: 473 I10L peptide Georgia 2007/1, 136-146, 11
SEQ ID NO: 474 I10L protein BA71
SEQ ID NO: 475 I10L protein Georgia 2007/1
SEQ ID NO: 476 I215L peptide Georgia 2007/1, 1-10, 10
SEQ ID NO: 477 I215L protein Georgia 2007/1
SEQ ID NO: 478 I226R peptide BA71
SEQ ID NO: 479 I226R peptide BA71
SEQ ID NO: 480 I226R peptide BA71
SEQ ID NO: 481 I226R peptide Georgia 2007/1
SEQ ID NO: 482 I226R peptide Georgia 2007/1
SEQ ID NO: 483 I226R peptide Georgia 2007/1
SEQ ID NO: 484 I226R peptide Georgia 2007/1
SEQ ID NO: 485 I226R peptide Georgia 2007/1, 150-157, 8
SEQ ID NO: 486 I226R peptide Georgia 2007/1, 51-58, 8
SEQ ID NO: 487 I226R protein BA71
SEQ ID NO: 488 I226R protein BA71
SEQ ID NO: 489 I226R protein Georgia2007/1
SEQ ID NO: 490 I226R protein Georgia2007/1
SEQ ID NO: 491 I243L peptide BA71
SEQ ID NO: 492 I243L peptide Georgia 2007/1, 81-89, 9
SEQ ID NO: 493 I243L protein BA71
SEQ ID NO: 494 I243L protein Georgia 2007/1
SEQ ID NO: 495 I267L peptide Georgia 2007/1, 246-269, 24
SEQ ID NO: 496 I267L peptide Georgia 2007/1, 252-260, 9
SEQ ID NO: 497 I267L peptide Georgia 2007/1, 66-76, 11
SEQ ID NO: 498 I267L protein Georgia 2007/1
SEQ ID NO: 499 I329L peptide Georgia 2007/1, 136-145, 10
SEQ ID NO: 500 I329L peptide Georgia 2007/1, 182-190, 9
SEQ ID NO: 501 I329L protein Georgia 2007/1
SEQ ID NO: 502 I73R peptide BA71
SEQ ID NO: 503 I73R protein BA71
SEQ ID NO: 504 I73R protein Georgia2007/1
SEQ ID NO: 505 I7L peptide Georgia 2007/1, 28-37, 10
SEQ ID NO: 506 I7L protein Georgia 2007/1
SEQ ID NO: 507 I8L peptide Georgia 2007/1, 88-95, 8
SEQ ID NO: 508 I8L protein BA71
SEQ ID NO: 509 I8L protein Georgia2007/1
SEQ ID NO: 510 I9R peptide BA7
SEQ ID NO: 511 I9R peptide Georgia 2007/1, 63-73, 11
SEQ ID NO: 512 I9R protein BA71
SEQ ID NO: 513 I9R protein Georgia 2007/1
SEQ ID NO: 514 K145R peptide BA71
SEQ ID NO: 515 K145R peptide BA71
SEQ ID NO: 516 K145R peptide BA71
SEQ ID NO: 517 K145R peptide BA71
SEQ ID NO: 518 K145R peptide Georgia 2007/1
SEQ ID NO: 519 K145R peptide Georgia 2007/1
SEQ ID NO: 520 K145R peptide Georgia 2007/1
SEQ ID NO: 521 K145R peptide Georgia 2007/1
SEQ ID NO: 522 K145R peptide Georgia 2007/1, 43-58, 16
SEQ ID NO: 523 K145R peptide Georgia 2007/1, 48-57, 10
SEQ ID NO: 524 K145R protein BA71
SEQ ID NO: 525 K145R protein BA71
SEQ ID NO: 526 K145R protein Georgia 2007/1
SEQ ID NO: 527 K145R protein Georgia2007/1
SEQ ID NO: 528 K205R peptide Georgia 2007/1, 38-48, 11
SEQ ID NO: 529 K205R protein Georgia 2007/1

SEQ ID NO: 530 K421R peptide Georgia 2007/1, 69-86, 18
SEQ ID NO: 531 K421R peptide Georgia 2007/1, 78-86, 9
SEQ ID NO: 532 K421R protein Georgia 2007/1
SEQ ID NO: 533 K78R peptide Georgia 2007/1, 36-44, 9
SEQ ID NO: 534 K78R protein Georgia 2007/1
SEQ ID NO: 535 L11L protein BA71
SEQ ID NO: 536 L11L protein Georgia2007/1
SEQ ID NO: 537 L60L protein BA71
SEQ ID NO: 538 L60L protein Georgia2007/1
SEQ ID NO: 539 M1249L peptide BA71
SEQ ID NO: 540 M1249L peptide BA71

SEQ ID NO: 541 M1249L peptide BA71

SEQ ID NO: 542 M1249L peptide Georgia 2007/1

SEQ ID NO: 543 M1249L peptide Georgia 2007/1

SEQ ID NO: 544 M1249L peptide Georgia 2007/1

SEQ ID NO: 545 M1249L peptide Georgia 2007/1, 1068-1078, 11

SEQ ID NO: 546 M1249L peptide Georgia 2007/1, 1130-1140, 11

SEQ ID NO: 547 M1249L peptide Georgia 2007/1, 1130-1144, 15

SEQ ID NO: 548 M1249L peptide Georgia 2007/1, 266-275, 10

SEQ ID NO: 549 M1249L peptide Georgia 2007/1, 266-292, 27

SEQ ID NO: 550 M1249L peptide Georgia 2007/1, 270-279, 10

SEQ ID NO: 551 M1249L peptide Georgia 2007/1, 276-284, 9

SEQ ID NO: 552 M1249L peptide Georgia 2007/1, 282-291, 10

SEQ ID NO: 553 M1249L peptide Georgia 2007/1, 555-564, 10

SEQ ID NO: 554 M1249L peptide Georgia 2007/1, 583-590, 8

SEQ ID NO: 555 M1249L peptide Georgia 2007/1, 772-782, 11

SEQ ID NO: 556 M1249L peptide Georgia 2007/1, 778-789, 12

SEQ ID NO: 557 M1249L peptide Georgia 2007/1, 780-788, 9

SEQ ID NO: 558 M1249L peptide Georgia 2007/1, 917-933, 17

SEQ ID NO: 559 M1249L peptide Georgia 2007/1, 922-932, 11

SEQ ID NO: 560 M1249L peptide Georgia 2007/1, 923-933, 11

SEQ ID NO: 561 M1249L protein BA71

SEQ ID NO: 562 M1249L protein Georgia2007/1

SEQ ID NO: 563 M448R peptide BA71

SEQ ID NO: 564 M448R peptide Georgia 2007/1, 146-156, 11

SEQ ID NO: 565 M448R peptide Georgia 2007/1, 248-257, 10

SEQ ID NO: 566 M448R protein BA71

SEQ ID NO: 567 M448R protein BA71

SEQ ID NO: 568 M448R protein Georgia 2007/1

SEQ ID NO: 569 M448R protein Georgia 2007/1

SEQ ID NO: 570 MGF_100-1L peptide Georgia 2007/1, 68-86, 19

SEQ ID NO: 571 MGF_100-1L peptide Georgia 2007/1, 68-86, 19

SEQ ID NO: 572 MGF_100-1L protein Georgia 2007/1

SEQ ID NO: 573 MGF_100-1L protein Georgia 2007/1

SEQ ID NO: 574 MGF_100-1R peptide Georgia 2007/1, 103-113, 11

SEQ ID NO: 575 MGF_100-1R peptide Georgia 2007/1, 97-115, 19

SEQ ID NO: 576 MGF_100-1R protein Georgia 2007/1

SEQ ID NO: 577 MGF_110-11L peptide Georgia 2007/1, 84-94, 11

SEQ ID NO: 578 MGF_110-11L protein Georgia 2007/1

SEQ ID NO: 579 MGF_110-12L peptide Georgia 2007/1, 19-29, 11

SEQ ID NO: 580 MGF_110-12L protein Georgia 2007/1

SEQ ID NO: 581 MGF_110-14L peptide Georgia 2007/1, 72-82, 11

SEQ ID NO: 582 MGF_110-14L protein Georgia 2007/1

SEQ ID NO: 583 MGF_110-1L peptide Georgia 2007/1, 10-19, 10

SEQ ID NO: 584 MGF_110-1L peptide Georgia 2007/1, 77-87, 11

SEQ ID NO: 585 MGF_110-1L protein Georgia 2007/1

SEQ ID NO: 586 MGF_110-6L peptide BA71

SEQ ID NO: 587 MGF_110-6L protein BA71

SEQ ID NO: 588 MGF_110-6L protein Georgia2007/1

SEQ ID NO: 589 MGF_110-8L peptide Georgia 2007/1, 81-91, 11

SEQ ID NO: 590 MGF_110-8L protein Georgia 2007/1

SEQ ID NO: 591 MGF_110-9L peptide Georgia 2007/1, 101-110, 10

SEQ ID NO: 592 MGF_110-9L peptide Georgia 2007/1, 101-118, 18

SEQ ID NO: 593 MGF_110-9L peptide Georgia 2007/1, 138-147, 10

SEQ ID NO: 594 MGF_110-9L peptide Georgia 2007/1, 140-147, 8

SEQ ID NO: 595 MGF_110-9L peptide Georgia 2007/1, 150-167, 18

SEQ ID NO: 596 MGF_110-9L peptide Georgia 2007/1, 157-167, 11

SEQ ID NO: 597 MGF_110-9L peptide Georgia 2007/1, 252-262, 11

SEQ ID NO: 598 MGF_110-9L protein Georgia 2007/1

SEQ ID NO: 599 MGF_300-1L peptide Georgia 2007/1, 172-190, 19

SEQ ID NO: 600 MGF_300-1L peptide Georgia 2007/1, 179-189, 11

SEQ ID NO: 601 MGF_300-1L peptide Georgia 2007/1, 78-87, 10

SEQ ID NO: 602 MGF_300-1L protein Georgia 2007/1

SEQ ID NO: 603 MGF_300-4L peptide Georgia 2007/1, 163-174, 12

SEQ ID NO: 604 MGF_300-4L peptide Georgia 2007/1, 165-172, 8

SEQ ID NO: 605 MGF_300-4L protein Georgia 2007/1

SEQ ID NO: 606 MGF_360-10L peptide BA71

SEQ ID NO: 607 MGF_360-10L peptide Georgia 2007/1, 136-146, 11

SEQ ID NO: 608 MGF_360-10L peptide Georgia 2007/1, 195-206, 12

SEQ ID NO: 609 MGF_360-10L peptide Georgia 2007/1, 266-274, 9

SEQ ID NO: 610 MGF_360-10L protein BA71

SEQ ID NO: 611 MGF_360-10L protein Georgia 2007/1

SEQ ID NO: 612 MGF_360-11L peptide Georgia 2007/1, 221-229, 9

SEQ ID NO: 613 MGF_360-11L peptide Georgia 2007/1, 240-260, 21

SEQ ID NO: 614 MGF_360-11L peptide Georgia 2007/1, 247-257, 11

SEQ ID NO: 615 MGF_360-11L protein Georgia 2007/1
SEQ ID NO: 616 MGF_360-12L peptide Georgia 2007/1, 165-186, 22
SEQ ID NO: 617 MGF_360-12L peptide Georgia 2007/1, 174-182, 9
SEQ ID NO: 618 MGF_360-12L peptide Georgia 2007/1, 174-184, 11
SEQ ID NO: 619 MGF_360-12L peptide Georgia 2007/1, 266-274, 9
SEQ ID NO: 620 MGF_360-12L protein Georgia 2007/1
SEQ ID NO: 621 MGF_360-13L peptide Georgia 2007/1, 271-281, 11
SEQ ID NO: 622 MGF_360-13L protein Georgia 2007/1
SEQ ID NO: 623 MGF_360-14L peptide Georgia 2007/1, 195-206, 12
SEQ ID NO: 624 MGF_360-14L protein Georgia 2007/1
SEQ ID NO: 625 MGF_360-15R peptide Georgia 2007/1, 16-25, 10
SEQ ID NO: 626 MGF_360-15R peptide Georgia 2007/1, 37-46, 10
SEQ ID NO: 627 MGF_360-15R peptide Georgia 2007/1, 71-81, 11
SEQ ID NO: 628 MGF_360-15R protein Georgia 2007/1
SEQ ID NO: 629 MGF_360-18R peptide Georgia 2007/1, 159-167, 9
SEQ ID NO: 630 MGF_360-18R peptide Georgia 2007/1, 93-100, 8
SEQ ID NO: 631 MGF_360-18R protein Georgia 2007/1
SEQ ID NO: 632 MGF_360-1L peptide Georgia 2007/1, 184-192, 9
SEQ ID NO: 633 MGF_360-1L peptide Georgia 2007/1, 188-198, 11
SEQ ID NO: 634 MGF_360-1L peptide Georgia 2007/1, 192-200, 9
SEQ ID NO: 635 MGF_360-1L peptide Georgia 2007/1, 195-203, 9
SEQ ID NO: 636 MGF_360-1L peptide Georgia 2007/1, 244-254, 11
SEQ ID NO: 637 MGF_360-1L protein Georgia 2007/1
SEQ ID NO: 638 MGF_360-21R peptide Georgia 2007/1, 176-185, 10
SEQ ID NO: 639 MGF_360-21R peptide Georgia 2007/1, 177-187, 11
SEQ ID NO: 640 MGF_360-21R peptide Georgia 2007/1, 185-193, 9
SEQ ID NO: 641 MGF_360-21R peptide Georgia 2007/1, 189-199, 11
SEQ ID NO: 642 MGF_360-21R peptide Georgia 2007/1, 197-207, 11
SEQ ID NO: 643 MGF_360-21R peptide Georgia 2007/1, 246-256, 11
SEQ ID NO: 644 MGF_360-21R protein Georgia 2007/1
SEQ ID NO: 645 MGF_360-2L peptide Georgia 2007/1, 191-198, 8
SEQ ID NO: 646 MGF_360-2L peptide Georgia 2007/1, 191-207, 17
SEQ ID NO: 647 MGF_360-2L peptide Georgia 2007/1, 196-203, 8
SEQ ID NO: 648 MGF_360-2L protein Georgia 2007/1
SEQ ID NO: 649 MGF_360-3L peptide Georgia 2007/1, 167-186, 20
SEQ ID NO: 650 MGF_360-3L protein Georgia 2007/1
SEQ ID NO: 651 MGF_360-4L peptide Georgia 2007/1, 162-170, 9
SEQ ID NO: 652 MGF_360-4L peptide Georgia 2007/1, 363-372, 10
SEQ ID NO: 653 MGF_360-4L protein Georgia 2007/1
SEQ ID NO: 654 MGF_360-6L peptide Georgia 2007/1, 150-162, 13
SEQ ID NO: 655 MGF_360-6L peptide Georgia 2007/1, 356-364, 9
SEQ ID NO: 656 MGF_360-6L protein Georgia 2007/1
SEQ ID NO: 657 MGF_360-8L peptide BA71
SEQ ID NO: 658 MGF_360-8L peptide BA71
SEQ ID NO: 659 MGF_360-8L peptide Georgia 2007/1, 189-198, 10
SEQ ID NO: 660 MGF_360-8L peptide Georgia 2007/1, 195-206, 12
SEQ ID NO: 661 MGF_360-8L peptide Georgia 2007/1, 196-206, 11
SEQ ID NO: 662 MGF_360-8L peptide Georgia 2007/1, 80-90, 11
SEQ ID NO: 663 MGF_360-8L protein BA71
SEQ ID NO: 664 MGF_360-8L protein Georgia 2007/1
SEQ ID NO: 665 MGF_360-9L peptide Georgia 2007/1, 193-203, 11
SEQ ID NO: 666 MGF_360-9L peptide Georgia 2007/1, 257-267, 11
SEQ ID NO: 667 MGF_360-9L peptide Georgia 2007/1, 257-269, 13
SEQ ID NO: 668 MGF_360-9L peptide Georgia 2007/1, 259-267, 9
SEQ ID NO: 669 MGF_360-9L peptide Georgia 2007/1, 264-274, 11
SEQ ID NO: 670 MGF_360-9L peptide Georgia 2007/1, 300-307, 8
SEQ ID NO: 671 MGF_360-9L protein Georgia 2007/1
SEQ ID NO: 672 MGF_505-10R peptide Georgia 2007/1, 499-509, 11
SEQ ID NO: 673 MGF_505-10R protein Georgia 2007/1
SEQ ID NO: 674 MGF_505-11L peptide Georgia 2007/1, 111-129, 19
SEQ ID NO: 675 MGF_505-11L peptide Georgia 2007/1, 142-149, 8
SEQ ID NO: 676 MGF_505-11L peptide Georgia 2007/1, 230-247, 18
SEQ ID NO: 677 MGF_505-11L peptide Georgia 2007/1, 231-241, 11
SEQ ID NO: 678 MGF_505-11L peptide Georgia 2007/1, 308-327, 20
SEQ ID NO: 679 MGF_505-11L peptide Georgia 2007/1, 312-322, 11
SEQ ID NO: 680 MGF_505-11L peptide Georgia 2007/1, 315-322, 8
SEQ ID NO: 681 MGF_505-11L peptide Georgia 2007/1, 319-327, 9
SEQ ID NO: 682 MGF_505-11L peptide Georgia 2007/1, 528-538, 11
SEQ ID NO: 683 MGF_505-11L protein Georgia 2007/1
SEQ ID NO: 684 MGF_505-1R peptide BA71
SEQ ID NO: 685 MGF_505-1R peptide BA71
SEQ ID NO: 686 MGF_505-1R peptide Georgia 2007/1
SEQ ID NO: 687 MGF_505-1R peptide Georgia 2007/1
SEQ ID NO: 688 MGF_505-1R peptide Georgia 2007/1, 270-280, 11
SEQ ID NO: 689 MGF_505-1R peptide Georgia 2007/1, 427-437, 11
SEQ ID NO: 690 MGF_505-1R peptide Georgia 2007/1, 76-85, 10
SEQ ID NO: 691 MGF_505-1R protein BA71
SEQ ID NO: 692 MGF_505-1R protein Georgia2007/1
SEQ ID NO: 693 MGF_505-2R peptide BA71
SEQ ID NO: 694 MGF_505-2R peptide Georgia 2007/1, 160-168, 9

SEQ ID NO: 695 MGF_505-2R peptide Georgia 2007/1, 197-206, 10
SEQ ID NO: 696 MGF_505-2R peptide Georgia 2007/1, 311-319, 9
SEQ ID NO: 697 MGF_505-2R protein BA71
SEQ ID NO: 698 MGF_505-2R protein Georgia 2007/1
SEQ ID NO: 699 MGF_505-3R peptide BA71
SEQ ID NO: 700 MGF_505-3R peptide Georgia 2007/1, 75-85, 11
SEQ ID NO: 701 MGF_505-3R peptide Georgia 2007/1, 86-95, 10
SEQ ID NO: 702 MGF_505-3R protein BA71
SEQ ID NO: 703 MGF_505-3R protein Georgia 2007/1
SEQ ID NO: 704 MGF_505-4R peptide Georgia 2007/1, 204-212, 9
SEQ ID NO: 705 MGF_505-4R peptide Georgia 2007/1, 352-362, 11
SEQ ID NO: 706 MGF_505-4R protein Georgia 2007/1
SEQ ID NO: 707 MGF_505-5R peptide BA71
SEQ ID NO: 708 MGF_505-5R peptide Georgia 2007/1, 200-208, 9
SEQ ID NO: 709 MGF_505-5R peptide Georgia 2007/1, 204-212, 9
SEQ ID NO: 710 MGF_505-5R peptide Georgia 2007/1, 346-356, 11
SEQ ID NO: 711 MGF_505-5R peptide Georgia 2007/1, 354-366, 13
SEQ ID NO: 712 MGF_505-5R protein BA71
SEQ ID NO: 713 MGF_505-5R protein Georgia 2007/1
SEQ ID NO: 714 MGF_505-6R peptide Georgia 2007/1, 102-111, 10
SEQ ID NO: 715 MGF_505-6R peptide Georgia 2007/1, 427-435, 9
SEQ ID NO: 716 MGF_505-6R protein Georgia 2007/1
SEQ ID NO: 717 MGF_505-8R peptide BA71
SEQ ID NO: 718 MGF_505-8R peptide BA71
SEQ ID NO: 719 MGF_505-7R peptide Georgia 2007/1
SEQ ID NO: 720 MGF_505-7R peptide Georgia 2007/1
SEQ ID NO: 721 MGF_505-7R peptide Georgia 2007/1, 102-111, 10
SEQ ID NO: 722 MGF_505-8R protein BA71 (A469R)
SEQ ID NO: 723 MGF_505-8R protein BA71 (A469R)
SEQ ID NO: 724 MGF_505-7R protein Georgia 2007/1
SEQ ID NO: 725 MGF_505-7R protein Georgia 2007/1
SEQ ID NO: 726 MGF_505-9R peptide BA71
SEQ ID NO: 727 MGF_505-9R peptide Georgia 2007/1
SEQ ID NO: 728 MGF_505-9R peptide Georgia 2007/1
SEQ ID NO: 729 MGF_505-9R peptide Georgia 2007/1
SEQ ID NO: 730 MGF_505-9R peptide Georgia 2007/1
SEQ ID NO: 731 MGF_505-9R peptide Georgia 2007/1, 355-363, 9
SEQ ID NO: 732 MGF_505-9R protein BA71
SEQ ID NO: 733 MGF_505-9R protein Georgia 2007/1
SEQ ID NO: 734 MGF110-12L protein BA71
SEQ ID NO: 735 MGF110-12L protein Georgia2007/1
SEQ ID NO: 736 MGF110-13L protein BA71
SEQ ID NO: 737 MGF110-13L protein Georgia2007/1
SEQ ID NO: 738 MGF110-14L protein BA71
SEQ ID NO: 739 MGF110-14L protein Georgia2007/1
SEQ ID NO: 740 MGF110-1L protein BA71
SEQ ID NO: 741 MGF110-1L protein Georgia2007/1
SEQ ID NO: 742 MGF300-1L protein BA71
SEQ ID NO: 743 MGF300-1L protein Georgia2007/1
SEQ ID NO: 744 MGF300-4L protein BA71
SEQ ID NO: 745 MGF300-4L protein Georgia2007/1
SEQ ID NO: 746 MGF360-10L protein BA71
SEQ ID NO: 747 MGF360-10L protein Georgia2007/1
SEQ ID NO: 748 MGF360-11L protein BA71
SEQ ID NO: 749 MGF360-11L protein Georgia2007/1
SEQ ID NO: 750 MGF360-12L protein BA71
SEQ ID NO: 751 MGF360-12L protein Georgia2007/1
SEQ ID NO: 752 MGF360-14L protein BA71
SEQ ID NO: 753 MGF360-14L protein Georgia2007/1
SEQ ID NO: 754 MGF360-15R protein BA71
SEQ ID NO: 755 MGF360-15R protein Georgia2007/1
SEQ ID NO: 756 MGF360-2L protein BA71
SEQ ID NO: 757 MGF360-2L protein Georgia2007/1
SEQ ID NO: 758 MGF360-3L protein BA71
SEQ ID NO: 759 MGF360-3L protein Georgia2007/1
SEQ ID NO: 760 MGF360-4L protein BA71
SEQ ID NO: 761 MGF360-4L protein Georgia2007/1
SEQ ID NO: 762 MGF360-6L protein BA71
SEQ ID NO: 763 MGF360-6L protein Georgia2007/1
SEQ ID NO: 764 MGF360-8L protein BA71
SEQ ID NO: 765 MGF360-8L protein Georgia2007/1
SEQ ID NO: 766 MGF505-2R protein BA71
SEQ ID NO: 767 MGF505-2R protein Georgia2007/1
SEQ ID NO: 768 MGF505-4R protein BA71
SEQ ID NO: 769 MGF505-4R protein Georgia2007/1
SEQ ID NO: 770 MGF505-7R protein BA71 (A528R)
SEQ ID NO: 771 MGF505-6R protein Georgia2007/1
SEQ ID NO: 772 MGF505-8R protein BA71
SEQ ID NO: 773 MGF505-8R protein BA71
SEQ ID NO: 774 MGF505-7R protein Georgia2007/1
SEQ ID NO: 775 MGF505-7R protein Georgia2007/1
SEQ ID NO: 776 NP1450L peptide BA71
SEQ ID NO: 777 NP1450L peptide Georgia 2007/1, 1008-1016, 9
SEQ ID NO: 778 NP1450L peptide Georgia 2007/1, 102-110, 9
SEQ ID NO: 779 NP1450L peptide Georgia 2007/1, 1032-1040, 9
SEQ ID NO: 780 NP1450L peptide Georgia 2007/1, 1136-1146, 11
SEQ ID NO: 781 NP1450L peptide Georgia 2007/1, 1327-1336, 10
SEQ ID NO: 782 NP1450L peptide Georgia 2007/1, 575-587, 13
SEQ ID NO: 783 NP1450L peptide Georgia 2007/1, 645-653, 9
SEQ ID NO: 784 NP1450L peptide Georgia 2007/1, 776-784, 9
SEQ ID NO: 785 NP1450L protein BA71
SEQ ID NO: 786 NP1450L protein Georgia 2007/1
SEQ ID NO: 787 NP419L peptide BA71
SEQ ID NO: 788 NP419L peptide Georgia 2007/1, 355-363, 9
SEQ ID NO: 789 NP419L peptide Georgia 2007/1, 363-378, 16
SEQ ID NO: 790 NP419L protein BA71
SEQ ID NO: 791 NP419L protein Georgia 2007/1
SEQ ID NO: 792 NP868R peptide Georgia 2007/1, 176-186, 11
SEQ ID NO: 793 NP868R peptide Georgia 2007/1, 184-192, 9
SEQ ID NO: 794 NP868R peptide Georgia 2007/1, 495-515, 21
SEQ ID NO: 795 NP868R peptide Georgia 2007/1, 570-579, 10
SEQ ID NO: 796 NP868R protein Georgia 2007/1
SEQ ID NO: 797 O174L peptide Georgia 2007/1, 97-105, 9
SEQ ID NO: 798 O174L protein Georgia 2007/1

SEQ ID NO: 799 O61R peptide Georgia 2007/1, 23-38, 16
SEQ ID NO: 800 O61R protein Georgia 2007/1
SEQ ID NO: 801 P1192R peptide BA71
SEQ ID NO: 802 P1192R peptide BA71
SEQ ID NO: 803 P1192R peptide BA71
SEQ ID NO: 804 P1192R peptide Georgia 2007/1
SEQ ID NO: 805 P1192R peptide Georgia 2007/1
SEQ ID NO: 806 P1192R peptide Georgia 2007/1, 1023-1040, 18
SEQ ID NO: 807 P1192R peptide Georgia 2007/1, 1026-1033, 8
SEQ ID NO: 808 P1192R peptide Georgia 2007/1, 1031-1038, 8
SEQ ID NO: 809 P1192R peptide Georgia 2007/1, 1049-1056, 8
SEQ ID NO: 810 P1192R peptide Georgia 2007/1, 1057-1067, 11
SEQ ID NO: 811 P1192R peptide Georgia 2007/1, 189-197, 9
SEQ ID NO: 812 P1192R peptide Georgia 2007/1, 372-382, 11
SEQ ID NO: 813 P1192R peptide Georgia 2007/1, 584-592, 9
SEQ ID NO: 814 P1192R peptide Georgia 2007/1, 605-614, 10
SEQ ID NO: 815 P1192R peptide Georgia 2007/1, 744-751, 8
SEQ ID NO: 816 P1192R protein BA71
SEQ ID NO: 817 P1192R protein Georgia 2007/1
SEQ ID NO: 818 Q706L peptide BA71
SEQ ID NO: 819 Q706L peptide Georgia 2007/1, 137-144, 8
SEQ ID NO: 820 Q706L peptide Georgia 2007/1, 36-46, 11
SEQ ID NO: 821 Q706L peptide Georgia 2007/1, 47-55, 9
SEQ ID NO: 822 Q706L protein BA71
SEQ ID NO: 823 Q706L protein Georgia 2007/1
SEQ ID NO: 824 QP383R peptide BA71
SEQ ID NO: 825 QP383R peptide BA71
SEQ ID NO: 826 QP383R peptide BA71
SEQ ID NO: 827 QP383R protein BA71
SEQ ID NO: 828 QP383R protein Georgia2007/1
SEQ ID NO: 829 QP509L peptide Georgia 2007/1, 384-402, 19
SEQ ID NO: 830 QP509L peptide Georgia 2007/1, 392-400, 9
SEQ ID NO: 831 QP509L peptide Georgia 2007/1, 51-63, 13
SEQ ID NO: 832 QP509L peptide Georgia 2007/1, 76-85, 10
SEQ ID NO: 833 QP509L protein Georgia 2007/1
SEQ ID NO: 834 R298L 1 protein Georgia 2007/1
SEQ ID NO: 835 R298L peptide Georgia 2007/1, 189-199, 11
SEQ ID NO: 836 R298L peptide Georgia 2007/1, 189-214, 26
SEQ ID NO: 837 R298L peptide Georgia 2007/1, 193-201, 9
SEQ ID NO: 838 R298L peptide Georgia 2007/1, 193-203, 11
SEQ ID NO: 839 R298L peptide Georgia 2007/1, 198-207, 10
SEQ ID NO: 840 R298L peptide Georgia 2007/1, 205-214, 10
SEQ ID NO: 841 R298L peptide Georgia 2007/1, 220-230, 11
SEQ ID NO: 842 R298L peptide Georgia 2007/1, 99-108, 10
SEQ ID NO: 843 R298L protein Georgia 2007/1
SEQ ID NO: 844 S183L peptide Georgia 2007/1, 10-18, 9
SEQ ID NO: 845 S183L peptide Georgia 2007/1, 128-136, 9
SEQ ID NO: 846 S183L protein Georgia 2007/1
SEQ ID NO: 847 S273R peptide Georgia 2007/1, 113-122, 10
SEQ ID NO: 848 S273R peptide Georgia 2007/1, 96-104, 9
SEQ ID NO: 849 S273R protein Georgia 2007/1
SEQ ID NO: 850 X69R peptide Georgia 2007/1, 19-29, 11
SEQ ID NO: 851 X69R peptide Georgia 2007/1, 47-54, 8
SEQ ID NO: 852 X69R protein Georgia 2007/1
SEQ ID NO: 853 A240L protein BA71
SEQ ID NO: 854 A240L protein Georgia 2007/1
SEQ ID NO: 855 Multiepitope-I (ME-I) construct
SEQ ID NO: 856 Multiepitope-II (ME-II) construct
SEQ ID NO: 857 MGF505-7R protein Georgia 2007/1
SEQ ID NO: 858 M448R protein Georgia 2007/1
SEQ ID NO: 859 D1133L protein Georgia 2007/1
SEQ ID NO: 860 A240L protein Georgia 2007/1
SEQ ID NO: 861 CP312R protein Georgia 2007/1
SEQ ID NO: 862 D117L protein Georgia 2007/1
SEQ ID NO: 863 D117L protein Georgia 2007/1
SEQ ID NO: 864 D117L protein BA71
SEQ ID NO: 865 D117L protein BA71
SEQ ID NO: 866 B475L protein Georgia 2007/1
SEQ ID NO: 867 B475L protein BA71
SEQ ID NO: 868 CP2475L (p37) protein Georgia 2007/1
SEQ ID NO: 869 CP2475L (p37) protein BA71
SEQ ID NO: 870 CP2475L (p150) protein Georgia 2007/1
SEQ ID NO: 871 CP2475L (p150) protein BA71
SEQ ID NO: 872 M1249L protein Georgia 2007/1
SEQ ID NO: 873 M1249L protein BA71
SEQ ID NO: 874 MGF-505-9R protein Georgia 2007/1
SEQ ID NO: 875 MGF-505-9R protein BA71
SEQ ID NO: 876 P1192R protein Georgia 2007/1
SEQ ID NO: 877 P1192R protein BA71
SEQ ID NO: 878 MGF-505-1R protein Georgia 2007/1
SEQ ID NO: 879 MGF-505-1R protein BA71
SEQ ID NO: 880 MGF-505-3R protein Georgia 2007/1
SEQ ID NO: 881 MGF-505-3R protein BA71
SEQ ID NO: 882 EP424R protein Georgia 2007/1
SEQ ID NO: 883 EP424R protein BA71
SEQ ID NO: 884 C475L protein Georgia 2007/1
SEQ ID NO: 885 C475L protein BA71
SEQ ID NO: 886 B602L protein Georgia 2007/1
SEQ ID NO: 887 B602L protein BA71
SEQ ID NO: 888 CP530R protein Georgia 2007/1
SEQ ID NO: 889 CP530R protein BA71
SEQ ID NO: 890 D339L protein Georgia 2007/1
SEQ ID NO: 891 D339L protein BA71
SEQ ID NO: 892 I234L protein Georgia 2007/1
SEQ ID NO: 893 I234L protein BA71
SEQ ID NO: 894 I73R protein Georgia 2007/1
SEQ ID NO: 895 I73R protein BA71
SEQ ID NO: 896 DP238L protein Georgia 2007/1
SEQ ID NO: 897 DP238L protein BA71
SEQ ID NO: 898 I9R protein Georgia 2007/1
SEQ ID NO: 899 I9R protein BA71

SEQ ID NO: 900 CP312R peptide Georgia 2007/1
SEQ ID NO: 901 CP312R peptide Georgia 2007/1

EXAMPLES

Example 1—Material and Methods

Cells and Viruses

Porcine alveolar macrophages: Porcine alveolar macrophages (PAMs) from healthy conventional pigs (Landrace× Large White) were obtained by lung lavage with PBS 1× supplemented with 1 µg/ml gentamicin (Sigma-Aldrich). The PBS solution was administered through the trachea using a sterile funnel, pulmonary lobes were gently massaged for 5 minutes, and the volume was collected into a sterile container. After three washes with 250 ml of PBS solution, the recovered fluid was centrifuged at 400×g for 10 minutes. Cell pellets were washed once with PBS 1×, and suspended in RPMI 1640 medium (Gibco) supplemented with 2 mM L-glutamine (Invitrogen), 100 IU/mL of penicillin (Invitrogen), 100 µg/ml of streptomycin (Invitrogen) and 10% heat-inactivated porcine serum (Gibco). PAMs were maintained in cell culture at 37° C., 5% CO2, or were frozen in FBS 10% DMSO (Sigma-Aldrich) and stored at −150° C.

Primary pig fibroblasts: Establishment of primary fibroblasts cultures was performed from a 2 cm² piece of ear tissue sample following previously described protocols. Briefly, tissue was cut into small sections and incubated overnight at 37° C. with a 0.5% trypsin solution in PBS. Cells were filtered through a 40 µm cell strainer (Corning) to discard the remaining tissue lumps, and centrifuged at 150×g for 10 minutes. Supernatant was discarded and cells were resuspended in complete DMEM supplemented with 10% FBS (HyClone, GE HealthCare), 100 IU/ml of penicillin (Invitrogen), 100 µg/ml of streptomycin (Invitrogen), 2 mM L-glutamine (Invitrogen), and 50 IU/ml Nystatin (Sigma-Aldrich). Primary fibroblasts were seeded in T-flasks, and maintained their viability after multiple serial passages. Cell passaging was performed following standard protocols by trypsinization.

Peripheral blood mononuclear cells (PBMCs): Porcine PBMCs were isolated from whole blood using Histopaque-1077 (Sigma-Aldrich) density gradient solution. Blood samples drawn from the jugular vein of pigs into 10 ml EDTA vacutainer tubes (Becton Dickinson), were diluted 1:1 in PBS. Diluted blood was gently layered on the top of a 10 ml Histopaque-1077 in a 50 ml conical tube and centrifuged at 400×g for 30 minutes at 20° C., without acceleration nor break. The whitish buffy coat formed in the interphase containing the mononuclear cells was aspirated and transferred to a clean 15 ml conical tube, filled with PBS, and centrifuged at 400×g for 10 minutes at 20° C. Supernatant was discarded, and red blood cells were lysed by hypotonic shock using 9 ml sterile distilled water for 30 seconds followed by addition of 3.5 mL of 3.5% NaCl solution. Afterwards cells were centrifuged 400×g for 10 minutes at 20° C., washed with PBS, and suspended in RPMI 1640 medium (Gibco) supplemented with 2 mM L-glutamine (Invitrogen), 100 IU/mL of penicillin (Invitrogen), 100 µg/ml of streptomycin (Invitrogen) and 10% heat-inactivated FBS (HyClone, GE HealthCare). For their use in the ELISpot assays, 50 µM β-mercaptoethanol (Sigma-Aldrich) was added to the medium to help maintain a reducing environment.

Rabbit kidney RK13 cells: Rabbit kidney epithelial RK13 cell line (ATCC CCL-37) was cultured at 37° C., 5% $CO_2$ in DMEM supplemented with 10% FBS (HyClone, GE HealthCare), 100 IU/ml of penicillin (Invitrogen), 100 µg/ml of streptomycin (Invitrogen), and 2 mM L-glutamine (Invitrogen).

African swine fever viruses: Two different ASFV virulent field isolates were used: BA71 (Rodriguez J M et al., PLoS One 2015; 10(11): e0142889; obtained from the spleen of an infected animal in Badajoz, Spain in 1971; GenBank accession number KP055815) and Georgia2007/1 (Chapman D A et al., Emerg Infect Dis. 2011, 17(4): 599-605; obtained from tissue samples from pigs submitted to the World Organisation for Animal Health Reference Laboratory at the Institute for Animal Health, Pirbright, UK, on Jun. 4, 2007; GenBank accession number FR682468). The live attenuated BA71ΔCD2 virus, a deletion mutant from BA71 lacking the CD2v gene (EP402R) was previously obtained (WO 2015/091322).

Multiparametric in silico predictions of CD8⁺ T-cell epitopes: Georgia2007/1 proteome was retrieved from Uniprot (UP000141072) for in silico CD8⁺ T cell epitope prediction. Predictions were made using the NetMHCpan 3.0 software. 42 swine leukocyte antigen (SLA) class SLA I alleles were considered, and peptides ranging from 8 to 11 amino acid residues, with an IC50 (concentration of peptide inhibiting binding of a standard peptide by 50%) below 500 nM were selected. 8,648 different sequences were obtained. To further select the most promising theoretical CTL candidates, additional features were evaluated for each peptide, including:

i) Proteasome cleavage, analyzed by using the MHC-I Processing tool from IEDB (http://tools.iedb.org/processing). This program allows evaluating how efficiently a peptide or its N-terminally prolonged precursors can be liberated from its source protein by the immunoproteasome.

ii) Promiscuity: Number of SLA I alleles predicted to bind the peptide with an affinity of 500 nM or lower.

iii) Overlap: Number of predicted peptides with a SLA binding affinity of 500 nM or lower, overlapping in at least one amino acid to a given polypeptide.

iv) Peptide immunogenicity: Prediction of the immunogenicity of a peptide taking into account its amino acid properties and their position within the sequence (Calis J et al., 2013).

The values of each trait were divided in 10 intervals, so that the best values received a score of 10 and the worst ones were scored as 1. The final score consisted in the sum of all the values, and was finally used to select the best candidates.

Aiming to compare the repertoire of peptides selected, an additional list was made, incorporating TAPREG score as a new parameter, previously used to identify the CD2v CTL peptides from the E75 ASFV strain (Argilaguet et al., 2012). TAPREG server computes binding affinity of peptides to TAP using a Support Vector Machine Regression. The addition of TAPREG score provided an alternative list, and the final peptide selection was obtained combining both peptide lists. When overlapping peptides were found in both lists, both the best score and the larger peptide were selected. Additionally, larger peptides (15-27 amino acids) were selected according to the presence of more than 10 overlapping peptides in a given hot spot.

Mass Spectrometry-Based Immunopeptidomics

In vitro infection of PAMs with ASFV: 5×10⁶ PAMs/well were seeded in 6-well plates for ASFV infection, using the indicated multiplicity of infection (MOI). The respective virus inoculum (0.5 ml) was diluted in complete RPMI without serum and applied to the PAMs monolayers. Following a 2-hour incubation at 37° C., 5% $CO_2$, the inoculum was discarded, and cells were replenished with complete RPMI supplemented with 10% porcine serum (Gibco). A parallel plate subjected to same conditions was used to monitor the ASFV infection. In this case, cell supernatants were harvested and the virus kinetics were analyzed by qPCR, as previously described (Lacasta et al., 2014). Cells were incubated at 37° C. and 5% $CO_2$, and harvested by scrapping when cytopathic effect was evident (dependent on the MOI used). PAMs were centrifuged at 350×g for 5 minutes at 4° C. and washed with PBS. Supernatant was discarded and pellets frozen at −80° C. until used.

Affinity purification of SLA I molecules: SLA I-peptide complexes were immunoprecipitated using 4B7/8 α-SLA I antibody-conjugated CNBr Sepharose beads (GE Healthcare). Hybridome culture supernatant of mAb α-SLA I was used. Coupling of the antibody to CNBr-activated sepharose was performed following manufacturer's instructions. A D-tube dialyzer maxi with a molecular weight cut-off of 12-14 kDa (Novagen) was used to dialyze the antibody-containing supernatant at 4° C. against 0.1 M sodium carbonate buffer pH 8.3 containing 0.5 M NaCl (coupling buffer). Lyophilized sepharose was suspended in 1 mM HCl pH 3 and incubated at RT for 20 minutes in end-over-end rotation to wash away the lyophilization additives, centrifuged at 500×g for 2 minutes at RT, and washed once with coupling buffer. The antibody in coupling solution was added to the washed sepharose at an optimal coupling concentration of 0.8-1.2 mg/ml, and rotated end-over-end overnight at 4° C. The OD of the antibody solution at 280 nm was measured before and after coupling to determine the coupling efficiency and incubate longer if necessary. The sepharose was spun down at 500×g for 2 minutes at RT, and the coupling buffer discarded. Any remaining active groups were blocked for 2 hours at 4° C. in end-over-end rotation with 0.1 M Tris-HCl pH 8. The antibody-coupled sepharose was washed with three cycles of alternating pH using 0.1 M acetic acid, pH 4 containing 0.5 M NaCl (acidic wash buffer) and 0.1 M Tris-HCl, pH 8 containing 0.5 M NaCl, (basic wash buffer). The coupled sepharose was finally resuspended in 50 mM Tris-HCl, pH 8 containing 150 mM NaCl (immunoprecipitation buffer) for the immunoprecipitation. PBS 0.1% (w/v) sodium azide was used for long-term storage of the coupled sepharose at 4° C.

Cell pellets were thawed on ice and lysed with 500 µl of 1% n-Dodecyl β-D-Maltoside (Thermo Fisher Scientific) in immunoprecipitation buffer and 1× complete protease inhibitor cocktail (Thermo Fisher Scientific), and incubated for 8 hours at 4° C. with end-over-end rotation. Cell lysates were clarified by centrifugation at 20000×g for 20 minutes at 4° C., and incubated 2 hours at 4° C. end-over-end with sepharose without antibody attached to remove any protein non-specifically interacting with the sepharose. The 500 µl of clarified lysate were then added to an equal volume of 4B7/8 α-SLA I antibody-conjugated CNBr sepharose in immunoprecipitation buffer (approximately 250 µl of sepharose in 250 µl of buffer) an incubated at 4° C. overnight with end-over-end rotation. Non-specifically bound molecules were removed by washing with 15-20 sepharose volumes of 150 mM NaCl, 50 mM ammonium bicarbonate. SLA I-peptides complexes were eluted in 4-5 sepharose volumes of 50% acetonitrile, 5% formic acid, and stored at −80° C. until analysis.

Western blot to detect immunoprecipitated SLA I-peptide complexes: Five percent of the volume of each sample was evaporated to dryness using a Concentrator 5301 (Eppendorf), suspended in 25 of 1×NuPAGE LDS sample buffer (Invitrogen) with 10% β-mercaptoethanol, and heated at 100° C. for 5 minutes. Half of the sample volume (2.5% of the total eluted volume) was run in a 4-12% gradient NuPAGE Bis-Tris acrylamide SDS-PAGE (Invitrogen) at 200 V during 1.5 hours in 1×NuPAGE IVIES SDS running buffer (Invitrogen) containing NuPAGE antioxidant (Thermofisher). His-tagged protein ladder (Thermofisher) was used as molecular weight marker. The gel was transferred to a nitrocellulose membrane (Amersham, Protran Premium) using a XCell SureLock™ Mini-Cell with a blot module (Thermofisher) during 4 hours at 50 V in transfer buffer made of 12 mM Tris-HCl (pH 8) containing 96 mM glycine, and 20% methanol (v/v). Following transfer, the nitrocellulose membrane was stained with ATX Ponceau S red staining solution (Biochemika Fluka) and destained in distilled water to confirm protein transfer. Thereafter, the nitrocellulose membrane was blocked in 3% non-fat milk (w/v) dissolved in wash buffer (TBS 0.1% Tween-20) for 1 hour at RT with gentle agitation on an orbital shaker). 4B7/8 α-SLA I antibody in blocking buffer at a concentration of 4 µg/ml was added to the membrane, and incubated for 1 hour at RT with gentle agitation, following 3 washes for 20 minutes with wash buffer. The membrane was then incubated with anti-mouse IgG HRP-conjugated (Sigma-Aldrich) diluted 1:10000 in blocking buffer for 1 hour at RT with agitation. For the His-tag marker, mouse anti-His tag HRP-conjugated (Novex) 1:100000 was used. After extensive washing as described above, the specific signal on the membrane was developed by using Western Lightning Ultra chemiluminescence substrate (PerkinElmer) for 5 minutes at RT in the dark. A Fluorchem HD2 (Alpha Innotech) was used for imaging.

On-tip desalting and LC-MS/MS analysis: Samples were desalted with TopTips C18 (PolyLC Inc), following the standard procedure. The eluates obtained from the desalting process were evaporated to dryness and reconstituted in 20 ml of 5% MeOH, 1% HCOOH for analysis by liquid chromatography coupled to mass spectrometry (LC-MS/MS). The MS system used was an LTQ XL Orbitrap (ThermoFisher) equipped with a nanoESI ion source. The total amount of each sample (20 µl) was loaded into the chromatographic system consisting in a C18 preconcentration cartridge (Agilent Technologies) connected to a 15 cm long, 100 µm i.d. C18 column (Nikkyo Technos Co Ltd). The separation was done at 0.4 µL/min in a 120-minute acetonitrile gradient from 3 to 40% (solvent A: 0.1% formic acid, solvent B: acetonitrile 0.1% formic acid). The HPLC system was composed of an Agilent 1200 capillary nano pump, a binary pump, a thermostated micro injector and a micro switch valve. The LTQ XL Orbitrap was operated in the positive ion mode with a spray voltage of 1.8 kV. The spectrometric analysis was performed in a data dependent mode, acquiring a full scan followed by 10 MS/MS scans of the 10 most intense signals detected in the MS scan from the global list. The full MS (range 400-1800) was acquired in the Orbitrap with a resolution of 60.000. The MS/MS spectra were done in the linear ion-trap.

Database search and peptide identification: All LC-MS/MS spectra were searched using SEQUEST (Proteome Discoverer v1.4, ThermoFisher) using a combined database including *Sus Scrofa*, BA71 and Georgia2007/1 ASFV, and the 6-frame translation of each virus genome (in order to identify peptides in and out of known ORFs). The following parameters were fixed: peptide confidence=High, peptide rank=1, Xcorr>2. Additionally, pig-specific 9-mers identified were used to create a sequence logo for each PAMs batch using WebLogo. Each logo consists of stacks of symbols, one stack for each position in the sequence. The overall height of the stack indicates the sequence conservation at that position, while the height of symbols within the stack indicates the relative frequency of each amino acid at that position. The binding site description given by the sequence logo was used to select or discard dubious sequences.

ASFV Gene Expression Plasmids

Plasmids encoding full-length ASFV proteins: The ASFV gene expression library used was built based on the E75 ASFV isolate (GenBank accession number FN557520.1). E75 ORFs were cloned in frame with ubiquitin into the pCMV-Ub plasmid (Rodriguez F et al., 2001). Additional construction of plasmids based on the Georgia2007/1 sequence (GenBank accession number FR682468) was done following the same strategy. A FLAG-tag sequence was added before the stop codon of the Georgia2007/1 gene in order to confirm the protein expression by immunofluorescence.

Anti-FLAG-tag immunofluorescence to check protein expression: Protein expression of Georgia2007/1 plasmids was checked by anti-FLAG-tag immunofluorescence in transfected RK13 cells. Transfection of RK13 cells was done using Lipofectamine 3000 transfection kit (Invitrogen) according to the manufacturers' instructions. Mock-transfected cells served as negative control. After 2 days of incubation at 37° C. and 5% $CO_2$, cells were fixed with 3% PFA 1 hour at 4° C. followed by permeabilization with 0.2% Tween20 in PBS 30 minutes at 37° C. AlexaFluor 488-conjugated anti-FLAG-tag monoclonal antibody (MA1-142-A488, Invitrogen) was diluted 1:100 and added to the cells for 1 hour at RT. Hoechst 33342 (Life Technologies) was used for nucleus staining. Cells were finally examined by fluorescence microscopy.

ASFV multiepitope-encoding plasmids: CTL epitope prediction of the ASFV Georgia2007/1 proteins selected to be included in the multiepitopes constructs was performed using the NetMHCpan 3.0 software. Protein sequences were retrieved from the Georgia2007/1 proteome (Uniprot access number UP000141072). The 42 SLA I alleles available in NetMHCpan 3.0 were considered, and peptides ranging from 8 to 11 amino acid residues with an IC50 below 500 nM were selected for further analysis. Protein regions containing a high density of predicted epitopes were selected. In the multiepitope-II (ME-II), each domain also included a peptide identified by previous MS-based immunopeptidomics assays. A single DNA construct was designed with the domains, linked by an optimal proteasomal cleavage site (AAY) (Velders et al., 2001) and with ubiquitin as a leader sequence to enhance their SLA I processing and presentation (Rodriguez and Whitton, 2000; Argilaguet et al., 2012; Lacasta et al., 2014). Plasmids encoding the multiepitopes were synthesized by GenScript (New Jersey, USA; SEQ ID NOS: 855 and 856).

In Vivo Experiments

Animals and animal safety: Male Landrace×Large White piglets were used in all the in vivo experiments described. Pigs were fed ad libitum and identified by numbered ear tags, and a seven-day acclimation period was established before manipulation of the animals Animal care and procedures were carried out in accordance with the guidelines of the Good Experimental Practices and under the supervision of the Ethical and Animal Welfare Committee of the Universitat Autonoma de Barcelona (Spain).

Peptide immunization: Three- to four-week-old piglets were used for peptide immunization experiments, which were carried out at the IRTA Monells pig experimental farm (Girona, Spain). Pigs received two intramuscular administrations in the hindquarters 3-week apart. Peptide cocktails (1 ml) included 20 nM of each peptide with complete Freund's adjuvant (Thermo Fisher Scientific) in the first immunization and incomplete Freund's adjuvant (Thermo Fisher Scientific) in the second. EDTA-blood samples were drawn from the jugular vein 2 weeks after the second peptide administration for PBMCs isolation.

Source of PBMCs to be used as effector cells in different assays aiming to quantify ASFV-specific T-cell response: Pigs experimentally infected with Georgia2007/1 yields a 100% mortality, before they are capable to induce ASFV-specific T-cells. Therefore, an alternative route was followed to obtain ASFV-specific T-cells. For the isolation of PBMCs from ASF-convalescent animals, BA71ΔCD2 immunization-Georgia2007/1 challenge in vivo experiments were performed at the biosafety level 3 facilities at the Centre de Recerca en Sanitat Animal (IRTA-CReSA, Barcelona, Spain). Six- to eight-week-old piglets were used, and either $10^6$ plaque forming units (PFU) or $3.3 \times 10^4$ PFU of BA71ΔCD2 in 1 ml of PBS were administered intramuscularly to the animals as previously described (Monteagudo et al., 2017). Three weeks later, pigs were challenged intramuscularly with a lethal dose of $10^3$ genomic equivalent copies (GEC) of the Georgia2007/1 ASFV isolate. Three weeks after the BA71ΔCD2 immunization (before Georgia2007/1 challenge), and two to three weeks after the challenge, EDTA-blood samples were drawn and the isolated PBMCs were used in different assays to quantify ASFV-specific T-cell response.

Heterologous DNA prime-BA71ΔCD2 boost and Georgia2007/1 challenge: The high virulence of Georgia2007/1 hampers finding a lethal challenge dose allowing pig survival for more than a week, thus impeding monitoring of the immune response. To increase the chances to unmask the protective potential of specific ASFV antigens, a prime-boost protocol was established, priming animals with DNA vaccines (encoding specific ASFV antigens) and boosting with a low dose of BA71ΔCD2. Three- to four-week-old male Landrace×Large White piglets were housed together in an experimental box (12 $m^2$) of the biosafety level 3 facilities at IRTA-CReSA (Barcelona, Spain). Pigs were immunized with two doses of 0.6 mg in 1.5 ml saline of the correspondent endotoxin-free DNA plasmid or plasmid cocktail (Qiagen) two weeks apart. One-third of each vaccine dose was intramuscularly injected into the femoral quadriceps, one-third into the trapezius muscle of the neck, and the last third was subcutaneously injected into the ear, according to an optimized protocol previously described (Argilaguet et al., 2011). Control pigs received the pCMV-Ub empty plasmid following the same administration protocol. Two weeks after the second DNA dose, a suboptimal dose (partially protective) of $10^3$ PFU of the BA71ΔCD2 live attenuated ASFV was administered to the pigs as a boost. Three weeks later, pigs were challenged intramuscularly with a lethal dose of $10^3$ GEC of the Georgia2007/1 ASFV isolate. Blood samples were drawn from the jugular vein of the pigs and nasal swabs were taken before and after each of the following time points: DNA prime (0, 4 and 7 dpp), BA71ΔCD2 boost (0, 4, 7 and 14 dpb), and Georgia2007/1 challenge (0, 4, 7, 14 and 21 dpc). Post-mortem examinations were carried out to confirm or discard the presence of ASFV-compatible pathological lesions.

Monitoring of ASF-compatible clinical signs: Animals were observed daily according to a welfare schedule to monitor their health status and to record the clinical signs after the infection with ASFV. Clinical evaluation included rectal temperature, behavior, body condition (prominence of vertebrae and ribs), cyanosis, digestive signs and respiratory signs. Each parameter was scored from 0 to 3 according to the severity (0: normal, 1: mild, 2: moderate, 3: severe), as described by Galindo-Cardiel and collaborators. The humane endpoint was reached when progression of the disease led to an unacceptable loss of general welfare (Galindo-Cardiel et al., 2013).

Quantification of virus titers in serum and nasal swabs by qPCR: Viral DNA from sera and nasal swab-PBS suspensions was quantified using a SYBR Green real-time PCR (qPCR) method previously described (Lacasta et al., 2014). Briefly, the viral genomic DNA was obtained from 200 µl of sera or swab-PBS suspensions using the NucleoSpin blood kit (Macherey-Nagel), and then employed as template to amplify an 85 bp-long fragment from the ASFV serine protein kinase gene (R298L) using PowerUp SYBR Green Master Mix (Thermo Fisher Scientific). Results were expressed as $\log_{10}$ numbers of GEC per ml of sera or nasal swab, and the limit of detection of the assay was established at $10^3$ GEC/ml.

Immunological Readouts

Porcine IFNγ ELISpot: IFNγ response was assessed by ELISpot assay using purified mouse anti-pig IFNγ Clone P2G10 (BD Pharmingen) as capture antibody and biotinylated mouse anti-porcine IFNγ antibody P2C11 (BD Pharmingen) as detection antibody, following a previously reported method (Lacasta et al., 2014). Briefly, 96-well plates (Costar 3590, Corning) were coated overnight at 4° C. with 5 µg/ml capture antibody in carbonate-bicarbonate buffer, pH 9.6. Plates were washed 3× with PBS, and blocked 1 hour at 37° C. with complete RPMI with 10% FBS. $5 \times 10^5$ PBMCs/well were used in a final volume of 200 with the correspondent stimuli. Peptides were added as a stimulus at a final concentration of 4 µg/ml, and RPMI and 10 µg/ml phytohaemagglutinin-M (PHA-M, Sigma-Aldrich) were used as negative and positive controls, respectively. When the LAV BA71ΔCD2 were used as stimulus, $10^5$ PFU were added per well. After overnight incubation at 37° C., 5% $CO_2$, cells were washed out with PBS 0.05% Tween20, and IFNγ was detected using 0.5 µg/ml of biotinylated anti-porcine IFNγ antibody 1 hour at 37° C. After washing, the ELISpot was developed by adding 50 µl of insoluble 3,3',5,5'-tetramethylbenzidine (TMB) substrate (Calbiochem) and stopped by washing with water. The frequency of specific IFNγ-secreting cells (IFNγ-SC) represented in the graphs is the mean of two replicates, subtracting the counts in the negative control wells. 300 spots/well was considered the limit of the assay resolution (wells with more than 300 spots received a score of 300).

For the use of fibroblasts as APCs in the ELISpot assay, the ratio used was 1 APC:5 autologous PBMCs. Plasmid transfection of the fibroblasts was done by electroporation using the Neon Transfection System 10 µl Kit (Invitrogen). Fibroblasts were collected by hypsinization, centrifuged at 250×g for 5 minutes at RT and washed with PBS. The appropriate number of cells (100000 fibroblasts/condition) were placed into a clean Eppendorf tube, and suspended in 10 µl of Neon Resuspension Buffer R, and mixed with 500 ng of the corresponding plasmid or plasmid cocktail. Electroporation was done with the following pulse conditions: pulse voltage=1700 V, pulse width=20 ms, pulse number=1. Fibroblasts electroporated with the empty pCMV-Ub plasmid were used as a negative control. Finally, electroporated cells were placed in the corresponding well of a 96-well plate with the autologous PBMCs and proceeded as described above. When working with transfected fibroblasts, no replicates were made. The number of spots in a control well using fibroblasts transfected with the empty pCMV-Ub plasmid, which never exceeded 10, was subtracted from the specific IFNγ-SC represented in the graphs.

Detection of ASFV-specific antibodies by ELISA: ASFV-specific antibodies in pig sera were detected by the OIE-approved indirect ELISA assay based on the use of soluble extracts from ASFV-infected cells (Gallardo et al., 2013). The presence of positive sera was detected using peroxidase-conjugated anti-pig IgG at 1/20000 dilution (Sigma-Aldrich) as secondary antibody and soluble TMB as specific peroxidase substrate (Sigma-Aldrich). Reactions were stopped with 1 N $H_2SO_4$ (Sigma-Aldrich). Plates were read at a wavelength of 450 nm and results were expressed as optical density (OD) values.

Example 2—in Silico Predictions, Immunopeptidomics and Gene Libraries: Identification of ASFV CD8+ T-Cell Epitopes The aim of this study was to explore the effectiveness of three different strategies for identifying ASFV CD8+ T-cell epitopes with protective potential against the Georgia2007/1 ASFV isolate, the virus currently circulating in Continental Europe and China.

The first approach here explored was a multiparametric bioinformatic analysis using the Georgia2007/1 proteome as a template for the prediction of the peptide sequences more likely to be promiscuously presented by the SLA I pathway.

The second strategy here employed consisted on characterizing the repertoire of ASFV SLA I-bound peptides found in PAMs in vitro infected with the virus. The potential of each individual peptide from both in silico predictions and immunopeptidomics assays to stimulate ASFV-specific T-cells was assessed by IFNγ ELISPOT, using as effector cells PBMCs from animals inoculated with the LAV BA71ΔCD2. Since BA71ΔCD2 is capable to confer protection against the heterologous Georgia2007/1 strain, it can be assumed that protective antigens will be shared between both isolates. In this in vitro stimulation assay, peptides directly bind to the SLA I molecules exposed on the cell surface and are capable to stimulate specific CD8+ T-cells, albeit they are limited to their specific SLA I molecule match.

The third strategy here tested sought to overcome the haplotype specificity of peptide-based assays by using as in vitro stimulators full-length proteins, which might contain epitopes with multiple SLA I specificities. Aiming to enhance the SLA I processing and presentation of the antigens, gene expression plasmids each encoding individual full-length ASFV ORFs fused to ubiquitin (Rodriguez and Whitton, 2000; Rodriguez et al., 2001) were used as a source of ASFV antigens for the assay. Individual plasmids were transfected into pig skin fibroblasts thus serving as APCs in an IFNγ ELISPOT assay, using autologous PBMCs of ASF-convalescent pigs as effector cells.

Results

Evaluation of Georgia2007/1 CD8+ T-cell epitope predictions: The sequences scoring the best theoretical ratings in the multiparametric bioinformatic analysis using the Georgia2007/1 proteome as a template were synthesized. The final selected set included 330 peptides from 110 ASFV proteins. 266 peptides were a direct output of the prediction software, thus ranging from 8 to 11 amino acids in length, and 64 longer sequences (12-27 amino acids in length) were selected due to the presence of multiple peptides with 10 or more overlapping predictions.

Out of the 330 predicted peptides, only one induced an IFNγ response in PBMCs from Georgia2007/1 survivors previously immunized with BA71ΔCD2, thereby in silico predictions yielding a percentage of 0.3% of recognized peptides. The immunogenic peptide corresponded to residues 68-86 of the MGF100-1L (SEQ ID NOS: 570 and 571), and 11 out of the 20 (55%) animals tested showed a specific IFNγ secretion. It has to be taken into account that the peptide is a 19-mer, and was therefore not a direct outcome of the software used, but it was selected because peptides within that sequence had more than 9 predicted CD8+ T-cell overlapping epitopes.

Evaluation of SLA I-restricted peptides identified by mass spectrometry-based immunopeptidomics: PAMs infected with either Georgia2007/1, BA71 or the LAV BA71ΔCD2 were used for the MS-based immunopeptidomics analysis. The increase of virus titers in the supernatants assessed by qPCR evidenced the replication of the viruses in the cells. After anti-SLA I immunoprecipitation and elution, the presence of SLA I-peptide complexes was confirmed by western blot. The band located between 40 and 50 kDa coincides with the expected molecular weight of about 45 kDa of the SLA class I heavy chain. The slightly heavier band and the 25 kDa band most probably correspond to the heavy and light chains of the anti-SLA I antibody used for immunoprecipitation, which have detached from the sepharose beads. Samples from non-infected PAMs were also analyzed by western blot to discard the possibility of an unspecific interaction of the anti-SLA I antibody.

Unfortunately, no peptides were found from Georgia2007/1-infected macrophages, independently of the PAMs used, or the multiplicity and time of infection. On the contrary, macrophages infected with BA71 or BA71ΔCD2 did render SLA I-specific peptides. These comparative assays allowed confirming that the lack of Georgia2007/1 SLA I-restricted peptides was strain-specific.

Using PAMs from three animals, 135 SLA I-bound peptides (106 different sequences) from 56 different ASFV proteins were identified. 84.3% of the sequences identified were identical for both BA71 and Georgia2007/1 isolates, 13% of the peptides only differed in 1 amino acid that theoretically did not play key roles in SLA I binding, and only 1.7% of them showed significant divergences in their sequence between both viruses, thus confirming the usefulness of this methodology to identify highly conserved peptides between ASFV strains.

Interestingly enough, while BA71-infected PAMs led to the determination of 44 ASFV sequences, 88 peptides were profiled from the BA71ΔCD2-infected samples. As expected for SLA I ligands, the length of peptides ranged from 8 to 13 amino acids, with 50% of the peptides being 9-mers. From the perspective of function, the biggest percentage was for proteins of unknown function, accounting for 35.6% of the total peptides, but peptides involved in transcription and replication, morphogenesis, host cell interaction, and from multi-gene families proteins were also identified. Regarding the temporal expression of the proteins during the infective cycle, early, intermediate and late proteins were identified, the latter ones representing the highest percentage (35.6%), although a 45.9% of the peptides came from proteins of unknown temporal expression.

With a total of 9 peptides, the ASFV protein from which the major number of peptides were identified was the uncharacterized protein B475L, followed by the structural polyprotein pp220 encoded by the CP2475L gene, and the helicase encoded by the D1133L ORF, from which 8 and 7 peptides were determined, respectively. Moreover, five SLA I peptides mapped in regions out of any known ORF, confirming results previously described (Jenson et al., 2000), and some of them without even having a conventional initiation codon. Strikingly, the five out of frame peptides were all identified from BA71ΔCD2-infected samples. Upholding the idea that these out of frame peptides could also be expressed and play a role in triggering protective response against the Georgia2007/1 ASFV, homologous sequences were found in the genome of the Georgia2007/1 isolate.

Out of the 111 different peptides identified by the immunopeptidomics approach, 5 induced an IFNγ response in PBMCs from animals surviving Georgia2007/1 challenge (Table 1), thus representing a 4.5% of the total number of peptides. Interestingly, the three peptides that were recognized by more than one tested animal were identified in BA71ΔCD2-infected PAMs, while the antigenic peptides profiled exclusively from BA71-infected samples induced an IFNγ response in only 10% of the animals Far from being conclusive, it suggests that the peptide repertoires of BA71ΔCD2 and BA71 are slightly different.

TABLE 1

ASFV epitopes from immunopeptidomics studies in vitro inducing an IFNγ response in PBMCs from ASF-convalescent animals inoculated with the LAV BA71ΔCD2. An animal was classified as responder if 20 or more spots were counted.

| Peptide sequence | Protein | Responding animals | Sample | Georgia2007/1 homology |
|---|---|---|---|---|
| NPTIIMEQY (SEQ ID NO: 456) | H339R | 1/10 (10%) | BA71 | 100% |
| KIILNTLMF (SEQ ID NO: 478) | I226R | 1/10 (10%) | BA71 | 100% |
| DKDGNSALHYL (SEQ ID NO: 17) | A238L | 6/20 (30%) | BA71ΔCD2 | 100% |
| AKIVEEGGEES (SEQ ID NO: 514) | K145R | 4/20 (20%) | BA71/BA71ΔCD2 | 100% |
| NSTLVIRI (SEQ ID NO: 717) | MGF505-8R | 4/20 (20%) | BA71ΔCD2 | NSTLVIRL (SEQ ID NO: 719, MGF505-7R) |

As expected, peptides were not uniformly recognized by all pigs, most probably reflecting their marked restriction for specific SLA alleles. Supporting this idea, inoculation of pigs with Freund's-adjuvanted cocktails of about 25 peptides identified by MS-based immunopeptidomics showed that some of the peptides were immunogenic but, again, not consistently recognized by all the pigs (Table 2). The peptides here employed were identified in the first immunopeptidomics analysis performed. Two immunization groups were defined depending on the theoretical binding affinity of each peptide to the SLA I alleles available at NetMHC-pan3.0. Those peptides having high binding affinities (IC50<1000 nM) to the majority of the alleles analyzed were classified as strong binders, while those with lower theoretical binding affinities (IC50>1000 nM) were grouped as weak binders. Two of the recognized peptides, from proteins D1133L and I226R, were classified as strong binders, while the third one, from protein G1211R, was a theoretical weak binder. Remarkably, opposed to what was expected according the theoretical predictions, the theoretical weak binder was recognized by 66.7% of the tested animals, while the two strong binders induced an IFNγ response in only one out of the six pigs (Table 2).

was used. Although the gene expression library contains almost 100 recombinant plasmids, the 15 tested and others encoding already known immunogenic proteins were not included here. In a first screening step, mixes of 10 or 11 plasmids were electroporated into fibroblasts to, later on, test the individual plasmids from the mixes capable to specifically induce IFNγ response. Expression of similar ASFV gene expression plasmids was confirmed by adding a FLAG-tag sequence at the C-terminus of the ASFV gene and detecting it by immunofluorescence, as described in this and the following Examples.

From the ASFV gene expression library, one single clone: pCMV-Ub-MGF505-7R was identified, capable of specifically stimulating IFNγ expression in all the tested animals except for one (FIG. 1). The non-responder pig (pig 13) did show ASFV-specific IFNγ-SC, thus discarding a possible immunosuppressed state of the PBMCs. Nevertheless, a failure in some specific electroporation events (one transfection per plasmid) could not be excluded. Remarkably, an individual peptide from MGF505-8R (MGF505-7R$_{334-341}$: NSTLVIRI; SEQ ID NO: 717), was identified in the immunopeptidomics assays using PAMs infected with BA71ΔCD2. The fact that this peptide was recognized by a

TABLE 2

ASFV-specific epitopes inducing an IFNγ response assessed by ELISpot in PBMCs of animals inoculated with Freund's-adjuvanted peptide cocktails.

| Theoretical binding | Peptide sequence | Protein | Responding animals | Sample | Georgia2007/1 homology |
|---|---|---|---|---|---|
| Strong | YKDETLPYL (SEQ ID NO: 285) | D1133L | 1/6 (16.7%) | BA71/ BA71ΔCD2 | 100% |
|  | KNILNTLMF (SEQ ID NO: 478) | I226R | 1/6 (16.7%) | BA71 | 100% |
| Weak | ENIAYERLETL (SEQ ID NO: 416) | G1211R | 4/6 (66.7%) | BA71ΔCD2 | ENI.YERLETL 90.9% (SEQ ID NO: 420) |

Use of gene expression plasmids for the identification of immunodominant ASFV CD8+ T-cell antigens: As reflected supra, peptide based approaches present a major drawback: limited presentation by restricted SLA haplotypes.

With the aim of avoiding this restriction and in an attempt to extend the studies described supra, it was aimed to identify promiscuous CD8+ T-cell determinants from ASFV, focusing on its full-length antigens. pCMV-Ub plasmids encoding full-length ASFV ORFs were transfected into primary fibroblasts and those were used as APCs in the ELISpot assay, using PBMCs from the same animal (autologous) as effector cells.

The optimal conditions for fibroblast electroporation using the Neon Transfection System were previously setup transfecting the pCMV-GFP plasmid into primary swine fibroblasts using different electroporation settings. The best condition was selected considering the percentage of transfected cells (GFP+) with respect to live cells. The conditions used gave a 36.14% of GFP+ cells and a mortality of 4.60%. Although it could not be assured that these values were constant in the following assays, it served as a proof of concept for demonstrating that the primary fibroblasts could express proteins under the pCMV promoter.

A collection of 73 recombinant plasmids belonging to an ASFV gene expression library available as described supra small proportion of ASF-convalescent pigs confirm its SLA I-restricted nature and argue positively in favor of the advantage of using the full-length MGF505-7R protein, containing multiple CD8+ T-cell determinants, in future developments.

Figure 2:
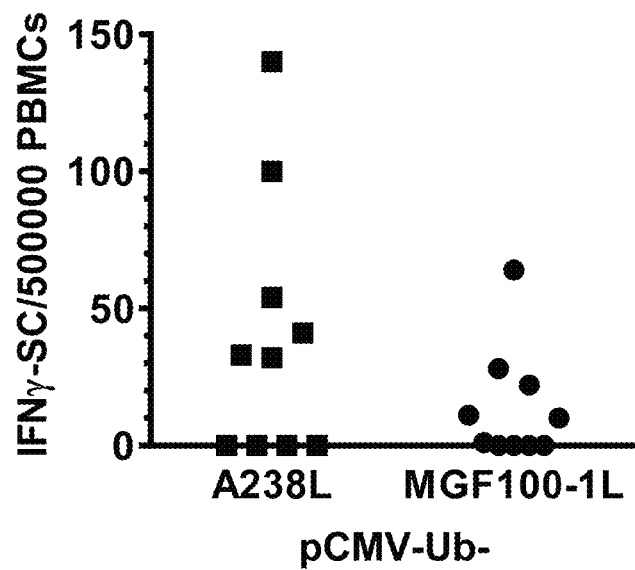
FIG. 2 depicts the IFNγ response to A238L and MGF100-1L full-length Georgia2007/1 proteins assessed by ELISpot assay using fibroblasts transfected with the pCMV-Ub-A238L and pCMV-Ub-MGF100-1L plasmids respectively as APCs and PBMCs from ASF-convalescent animals as effector cells.

Interestingly, two additional antigenic proteins were identified using this methodology: A238L and MGF100-1L. Despite those two proteins showed less promiscuity than MGF505-7R, they were still broadly recognized by ASFV-specific T-cells. Thus, fibroblasts transfected with the recombinant plasmids encoding the full-length A238L and MGF100-1L induced an IFNγ response in 60% and 50% of the animals after ASFV in vitro stimulation, respectively (FIG. 2). Interestingly, peptides previously identified from these proteins by immunopeptidomics analysis: A238L$_{81-91}$ and MGF100-1L$_{68-86}$ specifically stimulated an IFNγ response in 30% and 50% of the pigs, respectively.

Conclusion: The results displayed supra strongly suggest that immunopeptidome analysis of PAMs in vitro infected with ASFV are a more reliable strategy than in silico predictions for the identification of ASFV-specific CD8+ T-cell epitopes. However, peptides are not uniformly recognized by all pigs, probably reflecting their marked restriction for specific SLA alleles. This can be overcome by the use of full-length proteins, which here served to identify MGF505-

7R as a novel immunodominant and promiscuous ASFV antigen, and two additional antigens: A238L and MGF100-1L recognized by at least 50% of the animals tested. Therefore, focusing on full-length proteins instead of epitopes could be a more suitable approach for the identification of ASFV antigens with potential to promiscuously induce specific T-cell responses.

Example 3—M448R and MGF505-7R: Two Immunodominant ASFV Antigens with Protective Potential Since the marked restriction of peptides for specific SLA alleles is one of the major drawbacks of peptide-based vaccination approaches, in this present study there was a focus on full-length proteins. According to the identification of SLA I-restricted peptides by MS-based immunopeptidomics, 15 ASFV-encoded proteins were selected as potential inducers of CD8$^+$ T-cell responses.

In order to assess their immunogenicity and protective potential, pigs were inoculated with the 15 selected recombinant plasmids, each encoding an ASFV antigen with an ubiquitin sequence at the N-terminus, aiming to optimize SLA I presentation and enhance the induction of CD8$^+$ T-cell responses. A heterologous regimen including the DNA prime immunization with the 15 selected antigens followed by inoculation with a low dose of the live attenuated BA71ΔCD2 ASFV was applied as explained in Example 1. The cross-protective capabilities of BA71ΔCD2, conferring protection not only against the parental BA71 but also against heterologous viruses including the Georgia2007/1 isolate, should allow the enhancement of any cross-protective response induced by the recombinant plasmids, thus increasing the chance of identifying relevant antigen-specific T-cells. In addition, this immunization protocol allowed to evaluate the capability of pigs primed with the selected 15 antigens to achieve protection against a Georgia2007/1 lethal challenge, in comparison to a control group primed with a plasmid not encoding any ASFV specific protein.

In the first experiment here described, partial protection against a Georgia2007/1 challenge in pigs receiving the 15 selected antigens as a DNA prime vaccination was observed. One protein, M448R, showed the most immunodominant nature among the antigens included in the plasmid cocktail. Moreover, M448R exhibits a promiscuous cellular response in ASFV-convalescent pigs not receiving a DNA prime vaccination. As described in Example 1, the use of fibroblasts transiently expressing ASFV antigens as APCs for autologous PBMCs from ASF-convalescent pigs, allowed identifying another ASFV protein: MGF505-7R with a promiscuous nature similar to that of M448R. Therefore, both M448R and MGF505-7R were promising candidates to be further explored for their importance in ASFV protective immunity.

In consequence, the present study describes a second in vivo experiment designed to assess the immunogenicity and protective potential of M448R and MGF505-7R combined, using a prime-boost immunization protocol as above explained.

Results

DNA immunization with a cocktail of plasmids encoding 15 ASFV pre-selected proteins confers partial protection against Georgia2007/1 challenge infection: Based on previous results of an SLA I-immunopeptidomics study of ASFV-infected PAMs, 15 ASFV antigens were selected as potential candidates to induce CD8$^+$ T-cell responses, and their immunogenicity and protective potential against a Georgia2007/1 lethal challenge was assessed.

The selected set included three ASFV potential enzymes likely involved in nucleic acid metabolism: D339L (RNA polymerase subunit 7), EP424R (putative methyl transferase), and M448R (RNA ligase); as well as I243L, an assumed transcription factor. Also, two proteins involved in virion morphogenesis were included: the structural protein p37, product of the processing of the polyprotein pp220, and the chaperon B602L. Multigene family 505 members MGF505-1R and MGF505-3R were also selected, along with seven proteins of unknown function: B475L, DP238L, H339R, I226R, I73R, I9R and K145R. All the above mentioned proteins represent early, late and intermediate proteins during the ASFV replication cycle. Expression of the ASFV proteins here tested was confirmed by anti-FLAG-tag immunofluorescence in transfected RK13 cells as described in Example 1.

Figure 3:
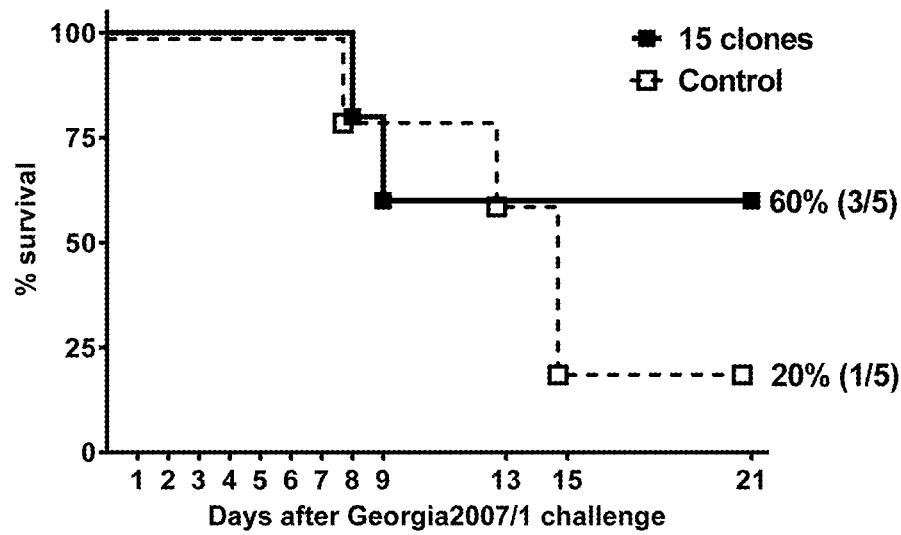
FIG. 3 depicts the survival percentage after Georgia2007/1 lethal challenge of pigs primed with either the selected 15 recombinant plasmids (15 clones) or the empty pCMV-Ub plasmid (Control). Both groups were immunized with a low dose of the live attenuated virus (LAV) BA71ΔCD2.

Following the immunization protocol described in Example 1, three out of five (60%) pigs primed with the 15 recombinant plasmids survived the lethal challenge with Georgia2007/01. Conversely, and in line with previous results from the lab using the low dose of BA71ΔCD2, only one out of five (20%) of the control pigs immunized once with the low dose of BA71ΔCD2 survived (FIG. 3).

During the experiment, animals were monitored daily for ASF typical clinical signs, including fever, lethargy, general body condition, digestive signs, respiratory signs and cyanosis. Even though the four surviving pigs developed transient ASF-compatible symptomatology, the three primed with the 15 recombinant plasmids showed milder clinical signs compared to the survivor from the control group. These results correlated with: i) delayed and shorter viremia in serum in surviving animals in the group primed with the 15 recombinant plasmids, ii) a reduction of 1 to 2 $\log_{10}$ in their maximum titers of the challenge virus, and iii) no detectable virus at any time post-challenge. In addition, a one to two $\log_{10}$ reduction in nasal shedding was observed compared to both the non-surviving animals and the survivor in the control group.

The survivor from the control group (pig 185) showed a high and prolonged fever peak (>41° C. for 5 days) starting at 4 dpc accompanied with an apathic behavior, while the three surviving animals in the 15 recombinant plasmids-primed group had mild fever lasting at most three days. Pig 181 experienced sporadic symptoms coinciding with mild fever peaks, and pig 184 had no apparent symptomatology throughout the study. Although survivor pig 180 also showed an apathic behavior and evident dyspnea. The onset of clinical signs was delayed compared to both the control that survived and the non-survivors. Pigs 182 and 183 of the "15 clones" group succumbed at 9 and 8 dpc, respectively, and their temperature and viral load in sera and in nasal swabs were similar to those in the control group.

Immunization with the 15 recombinant plasmids induces ASFV-specific T-cells, but no antibody response is detected: Administration of the 15 recombinant plasmids did not induce any specific antibody response but it did induce detectable ASFV-specific IFNγ response at 14 dpp, thus indicating the immunogenicity of at least one of the 15 included antigens.

After the BA71ΔCD2 vaccination, all the animals seroconverted and developed ASFV-specific T response. No clear correlation of protection was observed considering the level of antibodies or T cells induced after immunization, since control animals vaccinated only once with BA71ΔCD2 did also show a notable ASFV-specific immune response.

Notwithstanding, the two animals from the "15 clones" group that did not survive the Georgia2007/1 challenge showed the lowest level of antibodies and ASFV-specific T response at the time of challenge infection. The T-cell response induced directly after DNA immunization very likely contributed to a better control of ASFV infection and virus clearance in the "15 clones"-primed group.

M448R shows an immunodominant nature in ASFV-convalescent animals previously primed with the 15 recombinant plasmids: Once confirmed the immunogenicity of the administered plasmid cocktail, it was aimed to determine the immunogenic profile of each of the 15 ASFV antigens used. To this end, swine fibroblasts were electroporated with each individual recombinant plasmid contained in the immunization mix and used as APCs in an ELISpot assay with autologous PBMCs obtained at 14 dpc as effector cells.

Interestingly, high levels of IFNγ-SC (>50 spots) were exclusively detected in all the animals when PBMCs were incubated with fibroblasts transfected with pCMV-Ub-M448R. The number of M448R-specific IFNγ-SC was comparable to that obtained when transfecting the mix of the 15 recombinant plasmids. This result suggests that T-cell immunity towards M448R was largely responsible for the immunogenicity observed after immunization with the 15 recombinant plasmids. Furthermore, M448R-specific T-cells primed could have contributed to the milder course of Georgia2007/1 infection and increased survival in the "15 clones" group.

The number of spots when using ASFV as stimulus after the boost was much higher than when using swine fibroblasts transfected with the pCMV-Ub-M448R plasmid, most probably explained by different reasons. Firstly, ASFV infects APCs much better than plasmids transfect them, therefore being more efficiently processed. Secondly, PBMCs from ASFV recovered pigs might also recognize other antigens present in ASFV than those contained in the plasmid mix.

M448R induces a specific T-cell response during ASFV infection without a prior DNA prime: In a next step, it was attempted to determine if M448R induces ASFV specific $CD8^+$ T-cells not only when pigs were primed with pCMV-Ub-M448R, but also after ASFV infection. For this, PBMCs from BA71ΔCD2-immunized animals and challenged with a lethal dose of Georgia2007/1 (not previously primed with the pCMV-Ub-M448R plasmid) were tested in an ELISpot assay with autologous swine fibroblasts transfected with the pCMV-Ub-M448R plasmid. Strikingly, an IFNγ response against M448R when expressed in the pCMV-Ub plasmid was induced in 7 out of 9 animals, thus confirming the promiscuous nature of M448R and the presence of immunodominant T-cell epitopes within it.

Immunization with pCMV-Ub-M448R and pCMV-Ub-MGF505-7R confers partial protection against Georgia2007/1 lethal challenge: Given the immunodominant feature of M448R and its protective potential, it was decided to include it in future experimental vaccine formulations, together with MGF505-7R, a second antigen promiscuously recognized by ASF-convalescent pigs (Example 1). Therefore, the immunogenicity and protective potential of these two antigens was assessed by priming a group of pigs with two DNA plasmids encoding M448R and MGF505-7R proteins, with an ubiquitin sequence at the N-terminus, and boosting with a low dose of BA71ΔCD2.

Figure 4:
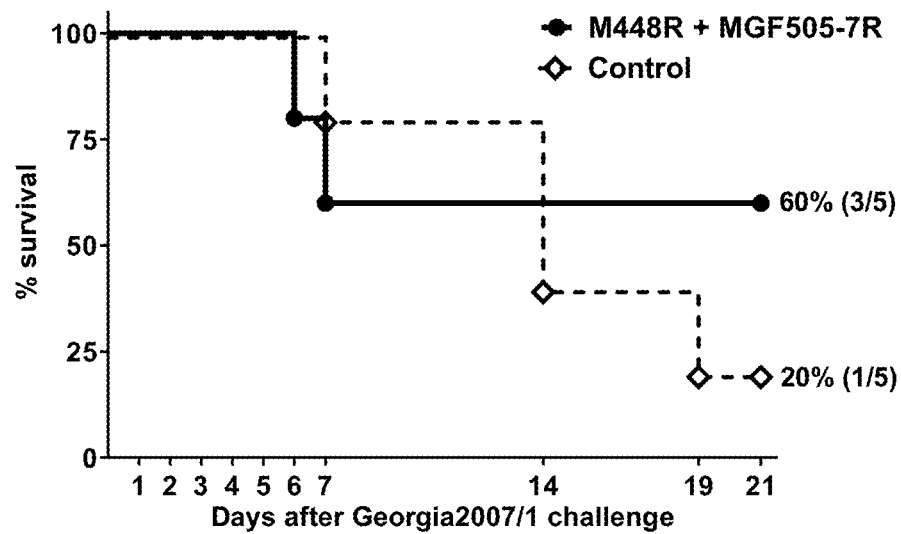
FIG. 4 depicts the percentage of surviving pigs within the M448R+MGF505-7R-primed group (solid line) and the control group (dashed line) after a Georgia2007/1 lethal challenge infection.

In line with previous results using a low dose of BA71ΔCD2, only one animal in the control group out of five (20%) survived the Georgia2007/1 challenge infection. In contrast, in the pCMV-Ub-M448R+pCMV-Ub-MGF505-7R-immunized group three out of five pigs survived the lethal challenge infection (FIG. 4).

Surviving animals from the DNA-primed group showed lower and shorter fever peaks than the control pigs. Thus, pig number 89 showed no fever and no other clinical signs at any time after the Georgia2007/1 challenge, and pig number 90 showed a brief peak of fever at 20-21 dpc. The third survivor in this group (pig 88) showed mild apathy and the body condition was slightly affected (clinical score never exceeded 2), but was completely recovered by day 14 post-challenge. Pigs number 86 and 87 from the DNA-primed group succumbed the infection showing ASF clinical signs indistinguishable from that found in control pigs (vaccinated with BA71ΔCD2 only). These included severe ASF symptoms, such as lethargy, depression, visible vertebrae and/or ribs, dyspnea and cyanosis (scoring at least 4 in the clinical signs scale).

ASF-clinical signs in the control group were more evident with two exceptions. Pig number 97 was found dead surprisingly late (at 19 dpc), after suffering a mild ASF symptomatology and high fever (>41° C.) for at least 2 consecutive days before dying, and pig number 99 which survived the Georgia2007/1 challenge despite suffering a prolonged lethargy starting at 9 dpc and lasting until the end of the trial, and also developing cyanosis in ears and tail.

Despite the survival percentage in the M448R+MGF505-7R-primed group was the same than when priming with the 15 clones (60%), the animals seemed to cope much better with the Georgia2007/1 infection, at least according to the clinical signs observed.

Priming with pCMV-Ub-M448R and pCMV-Ub-MGF505-7R contributes to reduced virus titers in serum and reduced nasal shedding after Georgia2007/1 challenge infection: Serum and nasal swabs were collected at the indicated sampling days and then tested for the presence of ASFV DNA by qPCR. After the BA71ΔCD2 vaccination, no viral DNA was found in either serum or nasal swabs from the DNA-primed animals. Conversely, and evidencing the replication of the LAV, a peak of viral DNA in the serum was detected in one control animal after administration of BA71ΔCD2.

After Georgia2007/1 inoculation, the level of viral DNA in the serum of the animals that survived always remained below $10^6$ GEC/ml, in contrast with the pigs that had to be sacrificed, all reaching at least $10^7$ GEC/ml at some time point after the infection. Focusing on the surviving animals, no ASFV DNA was detected in serum from animals 89 and 90, and low levels were found in nasal swabs, except for the virus peak found at 21 dpc in animal 90. These results concurred with the absence of clinical signs reported in these animals. The detection of ASFV DNA in both serum and nasal swab from animal 88 at 7 dpc is consistent with the mild ASF symptomatology observed in this surviving animal Despite the prolonged lethargy and cyanosis reported, the surviving animal in the control group (pig 99), was capable of controlling virus replication, showing low virus DNA levels in serum and reduced nasal shedding. The severe ASF clinical signs observed in the animals that had to be sacrificed from the DNA-primed group coincided with both high virus titers in serum and nasal swabs, and no difference was found between the succumbing animals in the immunized and the control group.

DNA immunization with pCMV-Ub-M448R and pCMV-Ub-MGF505-7R induces ASFV-specific T-cell response capable of recognizing both M488R and MGF505-7R antigens in vitro: As expected, administration of the pCMV-Ub-M448R and pCMV-Ub-MGF505-7R plasmids did not induce any detectable ASFV-specific antibody response. No difference was observed regarding antibody response among surviving and succumbing animals before Georgia2007/1 inoculation, all showing elevated levels at the day of challenge (except for pig number 100, which also showed weak T-cell response).

Also as expected, IFNγ response against swine fibroblasts transfected with pCMV-Ub-M448R and pCMV-Ub-MGF505-7R were detected 7 days after the second DNA immunization in DNA-primed animals, but not in the control group. Although low levels of IFNγ-SC were detected (likely because of low immunogenicity of DNA vaccines in large animals), this confirmed the immunogenicity of the tested antigens when administered in a DNA-based formulation. Notably, at this early time point, the two animals not showing M448R- and MGF505-7R-specific T-cell response (pigs 86 and 87) were the ones that later succumbed the Georgia2007/1 challenge.

In line with previous results showing the promiscuous and immunodominant nature of both M448R and MGF505-7R during ASFV infection, after the BA71ΔCD2 vaccination all the animals except one control (pig 100) were capable of recognizing their autologous swine fibroblasts transfected with the recombinant plasmid cocktail containing pCMV-Ub-M448R and pCMV-Ub-MGF505-7R. The control that did not respond showed low cellular and humoral responses throughout the whole experiment, reflecting perhaps an immunosuppressed state.

In order to characterize the response induced by each one of the antigens here tested, ELISpot assays were performed with swine fibroblasts transfected with either pCMV-Ub-M448R or pCMV-Ub-MGF505-7R. Simultaneous IFNγ response to M448R and MGF505-7R were detected in all the animals (except pig 86, which did not recognize MGF505-7R), thus discarding a possible immunodominance effect between M448R and MGF505-7R when administered in a DNA-based formulation. At a group level, the IFNγ response to both M448R and MGF505-7R of the three surviving animals (pigs 88, 89 and 90) was higher than the two animals that died (pigs 86 and 87) at all the analyzed time points. Again confirming the presence of M448R- and MGF505-7R-specific T-cells in Georgia2007/1-convalescent animals without a prior DNA prime immunization, the control animal that survived (pig 99) showed a notable IFNγ response to both antigens at the end of the trial.

Aiming to determine if the DNA prime immunization had an effect on the magnitude of ASFV-specific T-cell response, the number of IFNγ-secreting cells responding to BA71ΔCD2 after the vaccination with BA71ΔCD2 was assessed both early and late after the boost (at days 7 and 21 dpb, respectively). At 21 dpb, all pigs showed indistinguishable ASFV-specific T-cell response, with the exception of the low responder pig 100. IFNγ response was also detected in all the animals at 7 dpb, despite no significant differences were found between the DNA-primed animals and the control group. It is worth mentioning that the best IFNγ-responder within the control group, pig 99, was the only survivor.

Conclusion: In the present study, the feasibility of inducing ASFV-specific cellular response in pigs was confirmed by administering a cocktail of 15 plasmids encoding full-length ASFV proteins in frame with ubiquitin. It was demonstrated here that a heterologous immunization regimen including a DNA prime with the 15 recombinant plasmids followed by a low dose of the LAV BA71ΔCD2 confers partial protection against a Georgia2007/1 challenge. Protein M448R was the main responsible for the immunogenicity of the plasmid cocktail, thus suggesting its protective potential. Moreover, ASF-convalescent animals promiscuously recognized M448R, without receiving a prior DNA prime.

Following the same experimental design, DNA priming with M448R in combination with MGF505-7R, which was also shown to have an immunodominant and promiscuous nature (Example 1), did also result in a 60% survival percentage.

Example 4—Design of Multiepitope-Based DNA Constructs and Assessment of their Immunogenicity and Protective Potential Against ASFV In a first attempt to enhance the immunogenicity of the DNA constructs based on the Georgia2007/1 sequence, ASFV proteins in which the presence of CD8$^+$ T-cell determinants was previously described EP402R, CP312R and A240L, were analyzed for the presence of regions containing multiple theoretical CTL epitopes. These protein regions or "SLA I-hot spots" were selected to be included in the vaccine formulation, aiming to induce a wide repertoire of SLA I-restricted immune responses. Optimal proteasomal cleavage sites were added spacing the different protein domains, and the ubiquitin gene was used as a leader sequence. With this design, it was aimed to enhance the SLA I processing and presentation of the epitopes as previously reported, thus inducing specific CD8$^+$ T-cell responses while abolishing humoral responses. The immunogenicity of this multiepitope-encoding plasmid, referred to herein as multiepitope-I (ME-I; SEQ ID NO: 855), was confirmed in vivo. Confirming the efficacy of the strategy, pigs immunized with ME-I induced ASFV-specific T-cell response that specifically recognized peptides from EP402R, CP312R and A240L.

Extending this outcome for the identification of novel Georgia2007/1 antigens, according to Example 2, proteins with potential to induce CD8$^+$ T-cell responses were selected. Therefore, a selection was done based on analyses of the immunopeptidome profile of macrophages in vitro infected with ASFV, followed by in silico CTL epitope predictions of each one of them. Protein regions containing a high density of predicted epitopes and at least one SLA I-restricted peptide identified in the immunopeptidomics assays were selected as "SLA I-hot spots" for the design of a second multiepitope DNA construct (ME-II; SEQ ID NO: 856).

Seeking to increase the chances of success of the experimental vaccine prototype, the heterologous prime-boost immunization regimen described in Example 1 was used. Thus, animals were primed with the DNA plasmids encoding the multiepitope constructs, followed by an intramuscular inoculation with a low dose of the live attenuated BA71ΔCD2 virus. This model was useful not only to confirm the capability of the selected antigens to induce ASFV-specific CD8$^+$ T-cells, but also to evaluate their protective potential against a Georgia2007/1 lethal challenge.

Results

Selection of ASFV proteins with potential to trigger immunodominant CD8$^+$ T-cell responses and design of a multiepitope DNA construct: Results from SLA I-restricted immunopeptidomics assays were used to select ASFV proteins with potential to induce CD8$^+$ T-cell responses. The best protein candidates were selected according to three main criteria: (i) proteins from which 5 or more peptides were identified in SLA I-restricted immunopeptidomics assays, (ii) proteins from which peptides were identified using PAMs from different animals, and (iii) proteins from which a peptide had been recognized by specific T-cells obtained from pigs inoculated with the live attenuated virus (LAV) BA71ΔCD2 or with a peptide cocktail including that specific peptide (i.e. antigenic peptides).

With this data in mind, 13 proteins were finally selected for further analysis. Interestingly, 4 of these proteins corresponded to ASFV enzymes involved in nucleic acid metabolism: G1211R (DNA polymerase beta), D1133L (helicase), P1192R (DNA topoisomerase II), and EP424R (putative methyl transferase); while another two correspond to the p150 and p37 structural proteins, encoded by the CP2475L ORF as a pp220 polyprotein precursor. Additionally, two multigene family 505 members resulted selected: MGF505-1R, probably involved IFN I inhibition and absent in the non-pathogenic OURT88/3 and BA71V ASFV, and MGF505-9R. Finally, the K145R ORF, previously identified as an immunodominant antigen using sera from convalescent pigs, was selected together with four additional ORFs with unknown functions: B475L, M1249L, H339R, and I226R.

In order to encode the 13 selected proteins in a unique ORF, each one was in silico analyzed to identify regions with a high density of epitopes using the NetMHCpan 3.0 software as described in Example 1. Finally, a single DNA construct was designed with the selected protein regions, linked by an optimal proteasomal cleavage site (AAY) (Velders et al., 2001) and with ubiquitin as a leader sequence aiming to enhance their SLA I processing and presentation. The final plasmid encodes, including the ubiquitin gene, a protein of 1,884 amino acids in length, hereinafter referred to as multiepitope-II (ME-II; SEQ ID NO: 856).

DNA immunization with ASFV multiepitope-based plasmids partially protects against Georgia2007/1 lethal challenge: To test the protective efficacy of the selected ASFV candidates, the prime-boost heterologous vaccination protocol previously described was evaluated. Both ME-I and ME-II were administered to the pigs. As represented in FIG. 5, three out of five pigs (60%) primed with the multiepitopes survived the Georgia2007/01 challenge, while only one out of the five controls (20%) did, coinciding with the expected results for the low dose of BA71ΔCD2 used.

In the group immunized with the multiepitopes, two of the three surviving animals (pigs 175 and 176) had not even two consecutive days of fever, and ASFV positive samples of serum and nasal swabs of these animals showed low virus titers, confirming the success of the DNA priming with the plasmids. Moreover, pig 175 remained free of ASF-compatible clinical signs throughout the experiment Animal 176 showed slight apathy and evident dyspnea starting at 14 dpc until the end of the trial, but not correlating with fever nor ASFV positive serum samples or nasal shedding. The third survivor (pig 178) showed continued but minor ASF symptomatology, and transient episodes of fever starting at 5 dpc, correlating with a prolonged detection of ASFV in both serum and nasal swabs. However, at the end of the experiment this animal was almost recovered, showing no fever and only a slight dyspnea, and undetectable levels of ASFV in serum and nasal swabs. Rectal temperature and virus titers of the pigs that had to be sacrificed from the ME-I+ME-II-primed group (177 and 179) were not different from those found in most of the animals in the control group.

The course of infection in the control group was in line with previous results using a low dose of BA71ΔCD2 (Monteagudo et al., 2017). In this group, ASF-compatible clinical signs were apparent from day 3 after the Geor-gia2007/1 challenge, coinciding with the onset of prolonged fever (all the animals had at least five consecutive days of fever), and in agreement with the virus titers in serum and nasal swabs. The surviving control animal (pig 185) had prolonged fever compared to the survivors in the ME-I+ ME-II-primed group, which also showed a delay in the appearance of symptoms of ASF.

Multiepitope-based DNA constructs encoding multiple epitopes from ASFV induce ASFV-specific T-cells in vivo: As expected, inoculation of the multiepitopes did not induce any ASFV-specific antibody response, but it did induce detectable ASFV-specific IFNγ response, confirming the successful DNA priming with the chosen antigens. After the BA71ΔCD2 boost, all the pigs seroconverted and the number of ASFV-specific T-cells increased notably. As described before, no correlation seems to exist between the level of antibodies or specific T-cells at the challenge time point and the protection afforded, at least when measured by the techniques employed here.

Confirming the antigenicity of the multiepitope DNA constructs, IFNγ response was detected by ELISpot when they were transfected into fibroblasts and these used as APCs for autologous PBMCs obtained at 21 dpb.

Identification of ASFV antigens: DNA-primed vs not-primed animals: With the aim of determining and rank the immunogenicity of the individual ASFV antigens encoded in the multiepitope-based DNA constructs, pCMV-Ub plasmids encoding each of the full-length proteins included in both ME-I and ME-II were transfected into fibroblasts, and these used as APCs in the ELISpot assay. Expression of the full-length ASFV antigens here employed was confirmed by immunofluorescence as described in Example 1. In order to determine the role that DNA-priming can have on induction and modulation of T-cell responses, PBMCs from BA71ΔCD2-inoculated animals both primed with the multiepitopes and without a prior DNA prime were used as effector cells in the ELISpot assay. While almost all the clones stimulated a specific IFN-gamma response, in both cases proteins CP312R and D1133L showed the most promiscuous nature. Strikingly, while 3 out of the 5 ASFV-infected animals not previously primed responded to CP312R and D1133L, IFN-gamma production was observed in all the DNA-primed animals, suggesting an effect of the DNA prime on the induction of specific T-cell response against these two antigens. An increase on the number of animals responding to A240L was also seen in DNA-primed animals. These results demonstrate the successful DNA priming using designed multiepitopes to characterize two not previously described immunodominant ASFV antigens: CP312R and D1133L, with potential to induce protective T-cell responses.

Conclusion: The present study has proven the feasibility of multiepitope DNA constructs to in vivo induce ASFV-specific T-cell response and increase survival after a Georgia2007/1 lethal challenge when included in a heterologous prime-boost immunization regimen using the LAV BA71ΔCD2 as a boost. The protective potential of the epitopes encoded in the DNA plasmids has therefore been confirmed, validating antigen selection based on immunopeptidomics studies of ASFV-infected macrophages. The use of allogeneic fibroblasts as APCs in the ELISpot assays allowed to narrow down the potential candidates and to identify CP312R and D1133L as highly promiscuous antigens.

All of the compositions and methods disclosed and claimed herein can be made and executed without undue experimentation in light of the present disclosure. While the compositions and methods of this invention have been described in terms of specific aspects, it will be apparent to those of skill in the art that variations may be applied to the compositions and methods and in the steps or in the sequence of steps of the method described herein without departing from the concept, spirit and scope of the invention. More specifically, it will be apparent that certain agents which are both chemically and physiologically related may be substituted for the agents described herein while the same or similar results would be achieved. All such similar substitutes and modifications apparent to those skilled in the art are deemed to be within the spirit, scope and concept of the invention as defined by the following claims.

REFERENCES

The following references, to the extent that they provide exemplary procedural or other details supplementary to those set forth herein, are specifically incorporated herein by reference.
(1) Argilaguet J M et al., Vaccine 2011, 29: 5379-5385
(2) Argilaguet J M et al., PLoS One 2012, 7: e40942
(3) Calis J et al., PLoS Comput. Biol. 2013, 9: e1003266
(4) Chapman D A et al., Emerg Infect Dis. 2011, 17(4): 599-605
(5) De Villiers E P et al., Virology 2010, 400: 128-136
(6) Farlow J et al., Virology Journal 2018, 15(1): 190
(7) Galindo-Cardiel I et al., Virus Res 2013, 173: 180-190
(8) Gallardo C et al., Vet Microbiol 2013, 162: 32-43
(9) Jancovich J K et al., J Virol 2018, 92(8): e02219-17
(10) Jenson J S et al., J Immunol Methods 2000, 242: 33-42
(11) Lacasta A et al., J Virol 2014, 88: 13322-13332
(12) Lopera-Madrid J et al., Vet Immunol Immunopthol 2017, 185: 20-33
(13) Monteagudo P L et al., J Virol 2017, 91(21): e01058-17
(14) Netherton C L et al., Front Immunol. 2019 (10): 1318
(15) O'Donnell V et al., J Virol 2015, 89: 6048-6056
(16) Rodriguez F et al., J Virol 2001, 75: 7399-7409
(17) Rodriguez J M et al., PLoS One 2015; 10(11): e0142889
(18) Rodriguez F and Whitton J L, Virology 2000, 268: 233-238
(19) Sánchez E G et al., Virus Research 2019, 265: 150-155
(20) Velders M P et al., J Immunol 2001, 166: 5366-5373
(21) Uniprot Database accession number A0A2X0RVA9
(22) WO 2015/091322
(23) WO 2017/096341

The following clauses are also comprised by the scope and spirit of the present invention:

1. An immunogenic composition comprising
   (a) one, two or more African swine fever virus peptides and/or polypeptides, preferably full-length proteins, and/or immunogenic fragments thereof; and/or
   (b) one, two or more African swine fever virus oligonucleotides and/or polynucleotides and/or immunogenic fragments thereof encoding African swine fever virus peptides and/or polypeptides, preferably full-length proteins, and/or immunogenic fragments thereof; and/or
   (c) a viral or bacterial vector, preferably a recombinant and/or non-naturally occurring viral or bacterial vector, comprising one, two or more African swine fever virus oligonucleotides and/or polynucleotides and/or immunogenic fragments thereof encoding African swine fever virus peptides and/or polypeptides, preferably full-length proteins, and/or immunogenic fragments thereof; and
   (d) optionally, one or more pharmaceutical- or veterinary-acceptable carriers or excipients, preferably said one or more carriers or excipients being suitable for oral, intradermal, intramuscular or intranasal application.

2. A vaccine or pharmaceutical composition comprising
   (a) one, two or more African swine fever virus peptides and/or polypeptides, preferably full-length proteins, and/or immunogenic fragments thereof; and/or
   (b) one, two or more African swine fever virus oligonucleotides and/or polynucleotides and/or immunogenic fragments thereof encoding African swine fever virus peptides and/or polypeptides, preferably full-length proteins, and/or immunogenic fragments thereof; and/or
   (c) a viral or bacterial vector, preferably a recombinant and/or non-naturally occurring viral or bacterial vector, comprising one, two or more African swine fever virus oligonucleotides and/or polynucleotides and/or immunogenic fragments thereof encoding African swine fever virus peptides and/or polypeptides, preferably full-length proteins, and/or immunogenic fragments thereof; and
   (d) one or more pharmaceutical- or veterinary-acceptable carriers or excipients, preferably said one or more carriers or excipients being suitable for oral, intradermal, intramuscular or intranasal application;
   (e) optionally, said vaccine or pharmaceutical composition further comprising an adjuvant.

3. The immunogenic composition as disclosed in clause 1 or the vaccine or pharmaceutical composition as disclosed in clause 2, wherein the African swine fever virus is selected from the group consisting of: BA71, BA71ΔCD2 and/or Georgia2007/1 strain(s).

4. The immunogenic composition or the vaccine or pharmaceutical composition as disclosed in any one of clauses 1 to 3, wherein according to (a) the one, two or more African swine fever virus peptides and/or polypeptides, preferably full-length proteins, and/or immunogenic fragments thereof comprise, preferably consist of, an amino acid sequence which is at least 90%, 91%, 92%, 93%, 94%, 95%, 97%, 98%, 99% or 100% identical to an amino acid sequence selected from the group consisting of: SEQ ID NOS: 1, 2, 3, 4, 5, 6, 7, 8, 9, 10, 11, 12, 13, 14, 15, 16, 17, 19, 21, 23, 25, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 1, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 272, 274, 275, 276, 277, 278, 279, 280, 281, 282, 283, 284, 285, 287, 289, 290, 291, 292, 293, 294, 295, 297, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 420, 422, 423, 424, 425, 426, 427, 428, 429, 430, 432, 434, 435, 436, 437, 438, 439, 440, 441, 442, 443, 444, 445, 446, 447, 448, 449, 450, 451, 452, 453, 454, 455, 456, 458, 460, 461, 462, 463, 464, 465, 466, 468, 470, 471, 472, 473, 474, 475, 476, 477, 478, 479, 481, 483, 484, 485, 486, 487, 489, 491, 492, 493, 494, 495, 496, 497, 498, 499, 500, 501, 502, 503, 504, 505, 506, 507, 508, 509, 510, 511, 512, 513, 514, 515, 516, 518, 520, 521, 522, 523, 524, 526, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 568, 570, 572, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693, 694, 695, 696, 697, 698, 699, 700, 701, 702, 703, 704, 705, 706, 707, 708, 709, 710, 711, 712, 713, 714, 715, 716, 717, 719, 721, 722, 724, 726, 727, 728, 729, 730, 731, 732, 733, 734, 735, 736, 737, 738, 739, 740, 741, 742, 743, 744, 745, 746, 747, 748, 749, 750, 751, 752, 753, 754, 755, 756, 757, 758, 759, 760, 761, 762, 763, 764, 765, 766, 767, 768, 769, 770, 771, 772, 774, 776, 777, 778, 779, 780, 781, 782, 783, 784, 785, 786, 787, 788, 789, 790, 791, 792, 793, 794, 795, 796, 797, 798, 799, 800, 801, 802, 803, 804, 805, 806, 807, 808, 809, 810, 811, 812, 813, 814, 815, 816, 817, 818, 819, 820, 821, 822, 823, 824, 825, 826, 827, 828, 829, 830, 831, 832, 833, 834, 835, 836, 837, 838, 839, 840, 841, 842, 843, 844, 845, 846, 847, 848, 849, 850, 851, 852, 853, 854.

5. The immunogenic composition or the vaccine or pharmaceutical composition as disclosed in any one of clauses 1 to 3, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof, comprise, preferably consist of, a nucleic acid sequence which is at least 80%, 85%, 90%, 91%, 92%, 93%, 94%, 95%, 97%, 98%, 99% or 100% identical to a nucleic acid sequence selected from the group consisting of: SEQ ID NOS: 18, 20, 22, 24, 26, 27, 270, 271, 273, 286, 288, 296, 298, 419, 421, 431, 433, 457, 459, 467, 469, 480, 482, 488, 490, 517, 519, 525, 527, 567, 569, 571, 573, 718, 720, 723, 725, 773, 775.

6. The immunogenic composition or the vaccine or pharmaceutical composition as disclosed in any one of clauses 1 to 5, wherein according to (c) the viral or bacterial vector is selected from the group consisting of: asfivirus viral vector, avipox virus viral vector, canine morbillivirus viral vector, herpes virus viral vector, varicella virus viral vector, Lawsonia spp., *Salmonella* spp.

7. The immunogenic composition or the vaccine or pharmaceutical composition as disclosed in clause 6, wherein the viral or bacterial vector comprises one, two or more African swine fever virus oligonucleotides and/or polynucleotides and/or immunogenic fragments thereof, which encode African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 80%, 85%, 90%, 91%, 92%, 93%, 94%, 95%, 97%, 98%, 99% or 100% identical to a nucleic acid sequence selected from the group consisting of: SEQ ID NOS: 18, 20, 22, 24, 26, 27, 270, 271, 273, 286, 288, 296, 298, 419, 421, 431, 433, 457, 459, 467, 469, 480, 482, 488, 490, 517, 519, 525, 527, 567, 569, 571, 573, 718, 720, 723, 725, 773, 775.

8. The immunogenic composition or the vaccine or pharmaceutical composition as disclosed in any one of clauses 1 to 7, wherein the African swine fever virus polypeptides, preferably full-length proteins, comprise, preferably consist of, an amino acid sequence which is at least 90%, 91%, 92%, 93%, 94%, 95%, 97%, 98%, 99% or 100% identical to an amino acid sequence selected from the group consisting of: SEQ ID NO: 21, SEQ ID NO: 23, SEQ ID NO: 853, SEQ ID NO: 854, SEQ ID NO: 65, SEQ ID NO: 66, SEQ ID NO: 256, SEQ ID NO: 257, SEQ ID NO: 272, SEQ ID NO: 274, SEQ ID NO: 295, SEQ ID NO: 297, SEQ ID NO: 378, SEQ ID NO: 388, SEQ ID NO: 389, SEQ ID NO: 430, SEQ ID NO: 432, SEQ ID NO: 466, SEQ ID NO: 468, SEQ ID NO: 487, SEQ ID NO: 489, SEQ ID NO: 524, SEQ ID NO: 526, SEQ ID NO: 566, SEQ ID NO: 568, SEQ ID NO: 561, SEQ ID NO: 562, SEQ ID NO: 572, SEQ ID NO: 691, SEQ ID NO: 692, SEQ ID NO: 722, SEQ ID NO: 724, SEQ ID NO: 772, SEQ ID NO: 774, SEQ ID NO: 732, SEQ ID NO: 733, SEQ ID NO: 816, SEQ ID NO: 817 and/or wherein the African swine fever virus peptides and/or immunogenic fragments thereof and/or African swine fever virus polypeptide/full-length protein immunogenic fragments comprise, preferably consist of, an amino acid sequence which is at least 90%, 91%, 92%, 93%, 94%, 95%, 97%, 98%, 99% or 100% identical to an amino acid sequence selected from the group consisting of: SEQ ID NO: 17, SEQ ID NO: 19, SEQ ID NO: 25, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 261, SEQ ID NO: 262, SEQ ID NO: 263, SEQ ID NO: 264, SEQ ID NO: 265, SEQ ID NO: 266, SEQ ID NO: 258, SEQ ID NO: 259, SEQ ID NO: 260, SEQ ID NO: 267, SEQ ID NO: 268, SEQ ID NO: 269, SEQ ID NO: 281, SEQ ID NO: 282, SEQ ID NO: 283, SEQ ID NO: 284, SEQ ID NO: 285, SEQ ID NO: 287, SEQ ID NO: 289, SEQ ID NO: 290, SEQ ID NO: 291, SEQ ID NO: 292, SEQ ID NO: 293, SEQ ID NO: 294, SEQ ID NO: 372, SEQ ID NO: 373, SEQ ID NO: 374, SEQ ID NO: 375, SEQ ID NO: 376, SEQ ID NO: 377, SEQ ID NO: 379, SEQ ID NO: 380, SEQ ID NO: 381, SEQ ID NO: 382, SEQ ID NO: 383, SEQ ID NO: 384, SEQ ID NO: 385, SEQ ID NO: 386, SEQ ID NO: 387, SEQ ID NO: 416, SEQ ID NO: 417, SEQ ID NO: 418, SEQ ID NO: 420, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 454, SEQ ID NO: 455, SEQ ID NO: 456, SEQ ID NO: 458, SEQ ID NO: 460, SEQ ID NO: 461, SEQ ID NO: 462, SEQ ID NO: 463, SEQ ID NO: 464, SEQ ID NO: 465, SEQ ID NO: 478, SEQ ID NO: 479, SEQ ID NO: 481, SEQ ID NO: 483, SEQ ID NO: 484, SEQ ID NO: 485, SEQ ID NO: 486, SEQ ID NO: 514, SEQ ID NO: 515, SEQ ID NO: 516, SEQ ID NO: 518, SEQ ID NO: 520, SEQ ID NO: 521, SEQ ID NO: 522, SEQ ID NO: 523, SEQ ID NO: 563, SEQ ID NO: 564, SEQ ID NO: 565, SEQ ID NO: 539, SEQ ID NO: 540, SEQ ID NO: 541, SEQ ID NO: 542, SEQ ID NO: 543, SEQ ID NO: 544, SEQ ID NO: 545, SEQ ID NO: 546, SEQ ID NO: 547, SEQ ID NO: 548, SEQ ID NO: 549, SEQ ID NO: 550, SEQ ID NO: 551, SEQ ID NO: 552, SEQ ID NO: 553, SEQ ID NO: 554, SEQ ID NO: 555, SEQ ID NO: 556, SEQ ID NO: 557, SEQ ID NO: 558, SEQ ID NO: 559, SEQ ID NO: 560, SEQ ID NO: 570, SEQ ID NO: 684, SEQ ID NO: 685, SEQ ID NO: 686, SEQ ID NO: 687, SEQ ID NO: 688, SEQ ID NO: 689, SEQ ID NO: 690, SEQ ID NO: 717, SEQ ID NO: 719, SEQ ID NO: 721, SEQ ID NO: 726, SEQ ID NO: 727, SEQ ID NO: 728, SEQ ID NO: 729, SEQ ID NO: 730, SEQ ID NO: 731, SEQ ID NO: 801, SEQ ID NO: 802, SEQ ID NO: 803, SEQ ID NO: 804, SEQ ID NO: 805, SEQ ID NO: 806, SEQ ID NO: 807, SEQ ID NO: 808, SEQ ID NO: 809, SEQ ID NO: 810, SEQ ID NO: 811, SEQ ID NO: 812, SEQ ID NO: 813, SEQ ID NO: 814, SEQ ID NO: 815.

9. The immunogenic composition or the vaccine or pharmaceutical composition as disclosed in any one of clauses 1 to 8, wherein the ASFV polypeptide is an ASFV full-length protein, preferably encoded by a polynucleotide sequence comprising, more preferably consisting of, any possible open reading frame (ORF), even more preferably encoded by a polynucleotide sequence comprising, most preferably consisting of, an open reading frame (ORF) with a 5'-end start codon and a 3'-end stop codon.

10. The immunogenic composition or the vaccine or pharmaceutical composition as disclosed in any one of clauses 1 to 9, wherein the immunogenicity (and/or immunological response) of the immunogenic composition or the vaccine or pharmaceutical composition or any comprised immunogenic fragment is indicated/characterized by an induced IFN-gamma response, preferably in a porcine IFN-gamma ELISpot assay.

11. The immunogenic composition or the vaccine or pharmaceutical composition as disclosed in any one of clauses 1 to 10 for use in a method of reducing or preventing the clinical signs or disease in porcines, preferably a pig, caused by an infection with at least one pathogenic African swine fever virus or for use in a method of treating and/or preventing an infection with at least one pathogenic African swine fever virus, wherein preferably said clinical signs or disease caused by an infection with at least one pathogenic African swine fever virus or said infection with at least one pathogenic African swine fever virus are selected from the group consisting of: African swine fever, mortality, death, sudden death, fever, high fever, anorexia, lethargy, weakness, loss of appetite, recumbence, erythema, cyanotic skin blotching, diarrhea, constipation, abdominal pain, respiratory signs, coughing, vomiting, dyspnea, nasal and conjunctival discharges, hemorrhages, epistaxis, abortion, leukopenia, thrombocytopenia.

12. The immunogenic composition or the vaccine or pharmaceutical composition as disclosed in any one of clauses 1 to 10 for use in a method of immunizing a porcine, preferably a pig, against a clinical disease caused by at least one pathogenic African swine fever virus in said porcine, preferably pig, said method comprising the step of administering to the porcine, preferably pig, the immunogenic composition or the vaccine or pharmaceutical composition as claimed in any one of claims 1 to 10, wherein said immunogenic composition or vaccine or pharmaceutical composition fails to cause clinical signs of infection but is capable of inducing an immune response that immunizes the porcine, preferably pig, against pathogenic forms of said at least one African swine fever virus, wherein preferably said clinical disease or said clinical signs of infection are selected from the group consisting of: African swine fever, mortality, death, sudden death, fever, high fever, anorexia, lethargy, weakness, loss of appetite, recumbence, erythema, cyanotic skin blotching, diarrhea, constipation, abdominal pain, respiratory signs, coughing, vomiting, dyspnea, nasal and conjunctival discharges, hemorrhages, epistaxis, abortion, leukopenia, thrombocytopenia.

13. The immunogenic composition or the vaccine or pharmaceutical composition as disclosed in any one of clauses 1 to 10 for use in a method of prime-boost immunizing a porcine, preferably a pig, against a clinical disease caused by at least one pathogenic African swine fever virus in said porcine, preferably pig, said method comprising the step of administering to the porcine, preferably pig, once or twice an immunogenic composition or the vaccine or pharmaceutical composition as disclosed in any one of clauses 1 to 10 comprising (i) one, two or more African swine fever virus oligonucleotides and/or polynucleotides and/or immunogenic fragments thereof as sole immunogenic components or (ii) a viral vector, preferably a recombinant and/or non-naturally occurring viral vector, comprising one, two or more African swine fever virus oligonucleotides and/or polynucleotides and/or immunogenic fragments thereof—as sole immunogenic component (priming step); and subsequently—after priming once or twice—administering to the porcine, preferably pig, a live attenuated African swine fever virus, preferably BA71ΔCD2 (boosting step); wherein said immunogenic composition or vaccine or pharmaceutical composition as well as the live attenuated African swine fever virus independently from each other fail to cause clinical signs of infection but are capable of inducing an immune response that immunizes the porcine, preferably pig, against pathogenic forms of said at least one African swine fever virus, wherein preferably said clinical disease or said clinical signs of infection are selected from the group consisting of: African swine fever, mortality, death, sudden death, fever, high fever, anorexia, lethargy, weakness, loss of appetite, recumbence, erythema, cyanotic skin blotching, diarrhea, constipation, abdominal pain, respiratory signs, coughing, vomiting, dyspnea, nasal and conjunctival discharges, hemorrhages, epistaxis, abortion, leukopenia, thrombocytopenia.

14. A kit for vaccinating a porcine, preferably a pig, against a disease associated with and/or reducing the incidence or the severity of one or more clinical signs associated with or caused by at least one pathogenic African swine fever virus in a porcine, preferably a pig, comprising:
(a) a dispenser capable of administering a vaccine to said porcine; and
(b) immunogenic composition or the vaccine or pharmaceutical composition as disclosed in any one of clauses 1 to 10, and
(c) optionally an instruction leaflet;
wherein preferably said disease or said clinical signs are selected from the group consisting of: African swine fever, mortality, death, sudden death, fever, high fever, anorexia, lethargy, weakness, loss of appetite, recumbence, erythema, cyanotic skin blotching, diarrhea, constipation, abdominal pain, respiratory signs, coughing, vomiting, dyspnea, nasal and conjunctival discharges, hemorrhages, epistaxis, abortion, leukopenia, thrombocytopenia.

15. An African swine fever virus peptide and/or polypeptide, preferably full-length-protein, and/or immunogenic fragment thereof comprising, preferably consisting of, an amino acid sequence, which is at least 90%, 91%, 92%, 93%, 94%, 95%, 97%, 98%, 99% or 100% identical to an amino acid sequence selected from the group consisting of: SEQ ID NOS: 1, 2, 3, 4, 5, 6, 7, 8, 9, 10, 11, 12, 13, 14, 15, 16, 17, 19, 21, 23, 25, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 1, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 272, 274, 275, 276, 277, 278, 279, 280, 281, 282, 283, 284, 285, 287, 289, 290, 291, 292, 293, 294, 295, 297, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 420, 422, 423, 424, 425, 426, 427, 428, 429, 430, 432, 434, 435, 436, 437, 438, 439, 440, 441, 442, 443, 444, 445, 446, 447, 448, 449, 450, 451, 452, 453, 454, 455, 456, 458, 460, 461, 462, 463, 464, 465, 466, 468, 470, 471, 472, 473, 474, 475, 476, 477, 478, 479, 481, 483, 484, 485, 486, 487, 489, 491, 492, 493, 494, 495, 496, 497, 498, 499, 500, 501, 502, 503, 504, 505, 506, 507, 508, 509, 510, 511, 512, 513, 514, 515, 516, 518, 520, 521, 522, 523, 524, 526, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 568, 570, 572, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693, 694, 695, 696, 697, 698, 699, 700, 701, 702, 703, 704, 705, 706, 707, 708, 709, 710, 711, 712, 713, 714, 715, 716, 717, 719, 721, 722, 724, 726, 727, 728, 729, 730, 731, 732, 733, 734, 735, 736, 737, 738, 739, 740, 741, 742, 743, 744, 745, 746, 747, 748, 749, 750, 751, 752, 753, 754, 755, 756, 757, 758, 759, 760, 761, 762, 763, 764, 765, 766, 767, 768, 769, 770, 771, 772, 774, 776, 777, 778, 779, 780, 781, 782, 783, 784, 785, 786, 787, 788, 789, 790, 791, 792, 793, 794, 795, 796, 797, 798, 799, 800, 801, 802, 803, 804, 805, 806, 807, 808, 809, 810, 811, 812, 813, 814, 815, 816, 817, 818, 819, 820, 821, 822, 823, 824, 825, 826, 827, 828, 829, 830, 831, 832, 833, 834, 835, 836, 837, 838, 839, 840, 841, 842, 843, 844, 845, 846, 847, 848, 849, 850, 851, 852, 853, 854.

16. The African swine fever virus peptide and/or polypeptide, preferably full-length-protein, and/or immunogenic fragment thereof as disclosed in clause 15, wherein the African swine fever virus polypeptides, preferably full-length proteins, comprise, preferably consist of, an amino acid sequence which is at least 90%, 91%, 92%, 93%, 94%, 95%, 97%, 98%, 99% or 100% identical to an amino acid sequence selected from the group consisting of: SEQ ID NO: 21, SEQ ID NO: 23, SEQ ID NO: 853, SEQ ID NO: 854, SEQ ID NO: 65, SEQ ID NO: 66, SEQ ID NO: 256, SEQ ID NO: 257, SEQ ID NO: 272, SEQ ID NO: 274, SEQ ID NO: 295, SEQ ID NO: 297, SEQ ID NO: 378, SEQ ID NO: 388, SEQ ID NO: 389, SEQ ID NO: 430, SEQ ID NO: 432, SEQ ID NO: 466, SEQ ID NO: 468, SEQ ID NO: 487, SEQ ID NO: 489, SEQ ID NO: 524, SEQ ID NO: 526, SEQ ID NO: 566, SEQ ID NO: 568, SEQ ID NO: 561, SEQ ID NO: 562, SEQ ID NO: 572, SEQ ID NO: 691, SEQ ID NO: 692, SEQ ID NO: 722, SEQ ID NO: 724, SEQ ID NO: 772, SEQ ID NO: 774, SEQ ID NO: 732, SEQ ID NO: 733, SEQ ID NO: 816, SEQ ID NO: 817 and/or wherein the African swine fever virus peptides and/or immunogenic fragments thereof and/or African swine fever virus polypeptide/full-length protein immunogenic fragments comprise, preferably consist of, an amino acid sequence which is at least 90%, 91%, 92%, 93%, 94%, 95%, 97%, 98%, 99% or 100% identical to an amino acid sequence selected from the group consisting of: SEQ ID NO: 17, SEQ ID NO: 19, SEQ ID NO: 25, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 261, SEQ ID NO: 262, SEQ ID NO: 263, SEQ ID NO: 264, SEQ ID NO: 265, SEQ ID NO: 266, SEQ ID NO: 258, SEQ ID NO: 259, SEQ ID NO: 260, SEQ ID NO: 267, SEQ ID NO: 268, SEQ ID NO: 269, SEQ ID NO: 281, SEQ ID NO: 282, SEQ ID NO: 283, SEQ ID NO: 284, SEQ ID NO: 285, SEQ ID NO: 287, SEQ ID NO: 289, SEQ ID NO: 290, SEQ ID NO: 291, SEQ ID NO: 292, SEQ ID NO: 293, SEQ ID NO: 294, SEQ ID NO: 372, SEQ ID NO: 373, SEQ ID NO: 374, SEQ ID NO: 375, SEQ ID NO: 376, SEQ ID NO: 377, SEQ ID NO: 379, SEQ ID NO: 380, SEQ ID NO: 381, SEQ ID NO: 382, SEQ ID NO: 383, SEQ ID NO: 384, SEQ ID NO: 385, SEQ ID NO: 386, SEQ ID NO: 387, SEQ ID NO: 416, SEQ ID NO: 417, SEQ ID NO: 418, SEQ ID NO: 420, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 454, SEQ ID NO: 455, SEQ ID NO: 456, SEQ ID NO: 458, SEQ ID NO: 460, SEQ ID NO: 461, SEQ ID NO: 462, SEQ ID NO: 463, SEQ ID NO: 464, SEQ ID NO: 465, SEQ ID NO: 478, SEQ ID NO: 479, SEQ ID NO: 481, SEQ ID NO: 483, SEQ ID NO: 484, SEQ ID NO: 485, SEQ ID NO: 486, SEQ ID NO: 514, SEQ ID NO: 515, SEQ ID NO: 516, SEQ ID NO: 518, SEQ ID NO: 520, SEQ ID NO: 521, SEQ ID NO: 522, SEQ ID NO: 523, SEQ ID NO: 563, SEQ ID NO: 564, SEQ ID NO: 565, SEQ ID NO: 539, SEQ ID NO: 540, SEQ ID NO: 541, SEQ ID NO: 542, SEQ ID NO: 543, SEQ ID NO: 544, SEQ ID NO: 545, SEQ ID NO: 546, SEQ ID NO: 547, SEQ ID NO: 548, SEQ ID NO: 549, SEQ ID NO: 550, SEQ ID NO: 551, SEQ ID NO: 552, SEQ ID NO: 553, SEQ ID NO: 554, SEQ ID NO: 555, SEQ ID NO: 556, SEQ ID NO: 557, SEQ ID NO: 558, SEQ ID NO: 559, SEQ ID NO: 560, SEQ ID NO: 570, SEQ ID NO: 684, SEQ ID NO: 685, SEQ ID NO: 686, SEQ ID NO: 687, SEQ ID NO: 688, SEQ ID NO: 689, SEQ ID NO: 690, SEQ ID NO: 717, SEQ ID NO: 719, SEQ ID NO: 721, SEQ ID NO: 726, SEQ ID NO: 727, SEQ ID NO: 728, SEQ ID NO: 729, SEQ ID NO: 730, SEQ ID NO: 731, SEQ ID NO: 801, SEQ ID NO: 802, SEQ ID NO: 803, SEQ ID NO: 804, SEQ ID NO: 805, SEQ ID NO: 806, SEQ ID NO: 807, SEQ ID NO: 808, SEQ ID NO: 809, SEQ ID NO: 810, SEQ ID NO: 811, SEQ ID NO: 812, SEQ ID NO: 813, SEQ ID NO: 814, SEQ ID NO: 815.

17. An African swine fever virus oligonucleotide and/or polynucleotide and/or immunogenic fragment thereof encoding the African swine fever virus peptide and/or polypeptide, preferably full-length-protein, and/or immunogenic fragment thereof as disclosed in clause 16.

18. An African swine fever virus oligonucleotide and/or polynucleotide and/or immunogenic fragment thereof encoding African swine fever virus peptides and/or polypeptides, preferably full-length proteins, and/or immunogenic fragments thereof; comprising, preferably consisting of, a nucleic acid sequence which is at least 80%, 85%, 90%, 91%, 92%, 93%, 94%, 95%, 97%, 98%, 99% or 100% identical to a nucleic acid sequence selected from the group consisting of: SEQ ID NOS: 18, 20, 22, 24, 26, 27, 270, 271, 273, 286, 288, 296, 298, 419, 421, 431, 433, 457, 459, 467, 469, 480, 482, 488, 490, 517, 519, 525, 527, 567, 569, 571, 573, 718, 720, 723, 725, 773, 775.

19. The African swine fever virus peptide and/or polypeptide, preferably full-length-protein, and/or immunogenic fragment thereof as disclosed in any one of clauses 15 to 16 or the African swine fever virus oligonucleotide and/or polynucleotide and/or immunogenic fragment thereof encoding African swine fever virus peptide and/or polypeptide, preferably full-length-protein, and/or immunogenic fragments thereof as disclosed in any one of clauses 17 to 18, wherein the immunogenicity (and/or immunological response) of the immunogenic composition or the vaccine or pharmaceutical composition or any comprised immunogenic fragment is indicated/characterized by an induced IFN-gamma response, preferably in a porcine IFN-gamma ELISpot assay.

20. The African swine fever virus peptide and/or polypeptide, preferably full-length-protein, and/or immunogenic fragment thereof as disclosed in any one of clauses 15 to 16 or the African swine fever virus oligonucleotide and/or polynucleotide and/or immunogenic fragment thereof encoding African swine fever virus peptide and/or polypeptide, preferably full-length-protein, and/or immunogenic fragments thereof as disclosed in any one of clauses 17 to 18, wherein the ASFV polypeptide is an ASFV full-length protein, preferably encoded by a polynucleotide sequence comprising, more preferably consisting of, any possible open reading frame (ORF), even more preferably encoded by a polynucleotide sequence comprising, most preferably consisting of, an open reading frame (ORF) with a 5'-end start codon and a 3'-end stop codon.

21. A vector, preferably an expression vector, comprising one, two, three or more African swine fever virus oligonucleotides and/or polynucleotides and/or immunogenic fragments thereof as disclosed in any one of clauses 17 to 18.

22. The vector as disclosed in clause 21 comprising three African swine fever virus oligonucleotides and/or polynucleotides and/or immunogenic fragments thereof, preferably selected from EP402R, CP312R and A240L (multi-epitope-I, ME-I), more preferably comprising, most preferably consisting of, the nucleic acid sequence selected from the group consisting of: SEQ ID NO: 855; or comprising thirteen African swine fever virus oligonucleotides and/or polynucleotides and/or immunogenic fragments thereof, preferably selected from D1133L, G1211R, M1249L, MGF505-9R, P1192R, CP2475L (p150), B475L, EP424R, H339R, I226R, K145R, MGF505-1R and CP2475L (p37) (multiepitope-II, ME-II), more preferably comprising, most preferably consisting of, the nucleic acid sequence selected from the group consisting of: SEQ ID NO: 856.

23. A host cell, preferably a mammalian host cell, comprising the vector as disclosed in any one of clauses 21 to 22.

The following additional clauses are also comprised by the scope and spirit of the present invention:

24. An immunogenic composition comprising
(a) one, two or more African swine fever virus peptides and/or polypeptides, preferably full-length proteins, and/or immunogenic fragments thereof; and/or
(b) one, two or more African swine fever virus oligonucleotides and/or polynucleotides and/or immunogenic fragments thereof encoding African swine fever virus peptides and/or polypeptides, preferably full-length proteins, and/or immunogenic fragments thereof; and/or
(c) a viral or bacterial vector, preferably a recombinant and/or non-naturally occurring viral or bacterial vector, comprising one, two or more African swine fever virus oligonucleotides and/or polynucleotides and/or immunogenic fragments thereof encoding African swine fever virus peptides and/or polypeptides, preferably full-length proteins, and/or immunogenic fragments thereof; and
(d) optionally, one or more pharmaceutical- or veterinary-acceptable carriers or excipients, preferably said one or more carriers or excipients being suitable for oral, intradermal, intramuscular or intranasal application.

25. A vaccine or pharmaceutical composition comprising
(a) one, two or more African swine fever virus peptides and/or polypeptides, preferably full-length proteins, and/or immunogenic fragments thereof; and/or
(b) one, two or more African swine fever virus oligonucleotides and/or polynucleotides and/or immunogenic fragments thereof encoding African swine fever virus peptides and/or polypeptides, preferably full-length proteins, and/or immunogenic fragments thereof; and/or
(c) a viral or bacterial vector, preferably a recombinant and/or non-naturally occurring viral or bacterial vector, comprising one, two or more African swine fever virus oligonucleotides and/or polynucleotides and/or immunogenic fragments thereof encoding African swine fever virus peptides and/or polypeptides, preferably full-length proteins, and/or immunogenic fragments thereof; and
(d) one or more pharmaceutical- or veterinary-acceptable carriers or excipients, preferably said one or more carriers or excipients being suitable for oral, intradermal, intramuscular or intranasal application;

(e) optionally, said vaccine or pharmaceutical composition further comprising an adjuvant.

26. The immunogenic composition as disclosed in clause 24 or the vaccine or pharmaceutical composition as disclosed in clause 25, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: MGF505-7R/MGF505-8R (SEQ ID NOS: 774, 772, 724, 722, 721, 719, 717), M448R (SEQ ID NOS: 568, 566, 565, 564, 563), D1133L (SEQ ID NOS: 297, 295, 294, 293, 292, 291, 290, 289, 287, 285, 284, 283, 282, 281), CP312R (SEQ ID NOS: 274, 272, 269, 268, 267), A240L (SEQ ID NOS: 854, 853, 25), A238L (SEQ ID NOS: 23, 21, 19, 17), MGF100-1L (SEQ ID NOS: 572, 570), K145R (SEQ ID NOS: 526, 524, 523, 522, 521, 520, 518, 516, 515, 514), B475L (SEQ ID NOS: 66, 65, 64, 63, 62, 61, 60, 59, 58, 57, 56, 55, 54, 53, 52, 51, 50, 49, 48), H339R (SEQ ID NOS: 468, 466, 465, 464, 463, 462, 461, 460, 458, 456, 455, 454), I226R (SEQ ID NOS: 489, 487, 486, 485, 484, 483, 481, 479, 478), CP2475L (p37) (SEQ ID NOS: 266, 265, 264, 263, 262, 261), CP2475L (p150) (SEQ ID NOS: 260, 259, 258), G1211R (SEQ ID NOS: 432, 430, 429, 428, 427, 426, 425, 424, 423, 422, 420, 418, 417, 416), M1249L (SEQ ID NOS: 562, 561, 560, 559, 558, 557, 556, 555, 554, 553, 552, 551, 550, 549, 548, 547, 546, 545, 544, 543, 542, 541, 540, 539), MGF505-9R (SEQ ID NOS: 733, 732, 731, 730, 729, 728, 727, 726), P1192R (SEQ ID NOS: 817, 816, 815, 814, 813, 812, 811, 810, 809, 808, 807, 806, 805, 804, 803, 802, 801), MGF505-1R (SEQ ID NOS: 692, 691, 690, 689, 688, 687, 686, 685, 684), MGF505-3R (SEQ ID NOS: 703, 702, 701, 700, 699), EP424R (SEQ ID NOS: 389, 388, 387, 386, 385, 384, 383, 382, 381, 380, 379), C475L (SEQ ID NOS: 201, 200, 199, 198, 197, 196, 195, 194, 193, 192, 191, 190, 189, 188), B602L (SEQ ID NOS: 75, 74, 73, 72, 71, 70, 69, 68, 67), CP530R (SEQ ID NOS: 278, 277, 276, 275), D339L (SEQ ID NOS: 322, 321, 320), D117L (SEQ ID NOS: 862, 864), I243L (SEQ ID NOS: 494, 493, 492, 491), I73R (SEQ ID NOS: 504, 503, 502), DP238L (SEQ ID NOS: 327, 326, 325), I9R (SEQ ID NOS: 513, 512, 511, 510), preferably selected from the group consisting of: MGF505-7R/MGF505-8R (SEQ ID NOS: 774, 772, 724, 722, 721, 719, 717), M448R (SEQ ID NOS: 568, 566, 565, 564, 563), D1133L (SEQ ID NOS: 297, 295, 294, 293, 292, 291, 290, 289, 287, 285, 284, 283, 282, 281), CP312R (SEQ ID NOS: 274, 272, 269, 268, 267), A240L (SEQ ID NOS: 854, 853, 25), A238L (SEQ ID NOS: 23, 21, 19, 17), MGF100-1L (SEQ ID NOS: 572, 570); and most preferably selected from the group consisting of: MGF505-7R/MGF505-8R (SEQ ID NOS: 774, 772, 724, 722, 721, 719, 717), M448R (SEQ ID NOS: 568, 566, 565, 564, 563), D1133L (SEQ ID NOS: 297, 295, 294, 293, 292, 291, 290, 289, 287, 285, 284, 283, 282, 281), CP312R (SEQ ID NOS: 274, 272, 269, 268, 267), A240L (SEQ ID NOS: 854, 853, 25).

27. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: MGF505-7R/MGF505-8R (SEQ ID NOS: 774, 772, 724, 722, 721, 719, 717).

28. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: MGF505-7R (SEQ ID NO: 774).

29. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: MGF505-8R (SEQ ID NO: 772).

30. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: MGF505-7R (SEQ ID NO: 724).

31. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: MGF505-8R (SEQ ID NO: 722).

32. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: MGF505-7R (SEQ ID NO: 721).

33. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: MGF505-7R (SEQ ID NO: 719).

34. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: MGF505-8R (SEQ ID NO: 717).

35. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: M448R (SEQ ID NOS: 568, 566, 565, 564, 563).

36. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: M448R (SEQ ID NO: 568).

37. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: M448R (SEQ ID NO: 566).

38. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: M448R (SEQ ID NO: 565).

39. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: M448R (SEQ ID NO: 564).

40. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: M448R (SEQ ID NO: 563).

41. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NOS: 297, 295, 294, 293, 292, 291, 290, 289, 287, 285, 284, 283, 282, 281).

42. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 297).

43. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 295).

44. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 294).

45. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 293).

46. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 292).

47. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 291).

48. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 290).

49. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 289).

50. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 287).

51. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 285).

52. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 284).

53. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 283).

54. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 282).

55. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 281).

56. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: CP312R (SEQ ID NOS: 274, 272, 269, 268, 267).

57. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: CP312R (SEQ ID NO: 274).

58. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: CP312R (SEQ ID NO: 272).

59. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: CP312R (SEQ ID NO: 269).

60. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: CP312R (SEQ ID NO: 268).

61. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: CP312R (SEQ ID NO: 267).

62. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: A240L (SEQ ID NOS: 854, 853, 25).

63. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: A240L (SEQ ID NO: 854).

64. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: A240L (SEQ ID NO: 853).

65. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: A240L (SEQ ID NO: 25).

66. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: A238L (SEQ ID NOS: 23, 21, 19, 17).

67. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: A238L (SEQ ID NO: 23).

68. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: A238L (SEQ ID NO: 21).

69. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: A238L (SEQ ID NO: 19).

70. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: A238L (SEQ ID NO: 17).

71. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: MGF100-1L (SEQ ID NOS: 572, 570).

72. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: MGF100-1L (SEQ ID NO: 572).

73. The immunogenic composition or the vaccine or pharmaceutical composition as disclosed in clause 26, wherein according to (a) the one, two or more African swine fever virus peptides and/or polypeptides, preferably full-length proteins, and/or immunogenic fragments thereof comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: MGF100-1L (SEQ ID NOS: 570).

74. The immunogenic composition or the vaccine or pharmaceutical composition as disclosed in any one of clauses 24 to 73, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: MGF505-7R/MGF505-8R (SEQ ID NOS: 774, 772, 724, 722, 721, 719, 717), M448R (SEQ ID NOS: 568, 566, 565, 564, 563), D1133L (SEQ ID NOS: 297, 295, 294, 293, 292, 291, 290, 289, 287, 285, 284, 283, 282, 281), CP312R (SEQ ID NOS: 274, 272, 269, 268, 267), A240L (SEQ ID NOS: 854, 853, 25), A238L (SEQ ID NOS: 23, 21, 19, 17), MGF100-1L (SEQ ID NOS: 572, 570), K145R (SEQ ID NOS: 526, 524, 523, 522, 521, 520, 518, 516, 515, 514), B475L (SEQ ID NOS: 66, 65, 64, 63, 62, 61, 60, 59, 58, 57, 56, 55, 54, 53, 52, 51, 50, 49, 48), H339R (SEQ ID NOS: 468, 466, 465, 464, 463, 462, 461, 460, 458, 456, 455, 454), I226R (SEQ ID NOS: 489, 487, 486, 485, 484, 483, 481, 479, 478), CP2475L (p37) (SEQ ID NOS: 266, 265, 264, 263, 262, 261), CP2475L (p150) (SEQ ID NOS: 260, 259, 258), G1211R (SEQ ID NOS: 432, 430, 429, 428, 427, 426, 425, 424, 423, 422, 420, 418, 417, 416), M1249L (SEQ ID NOS: 562, 561, 560, 559, 558, 557, 556, 555, 554, 553, 552, 551, 550, 549, 548, 547, 546, 545, 544, 543, 542, 541, 540, 539), MGF505-9R (SEQ ID NOS: 733, 732, 731, 730, 729, 728, 727, 726), P1192R (SEQ ID NOS: 817, 816, 815, 814, 813, 812, 811, 810, 809, 808, 807, 806, 805, 804, 803, 802, 801), MGF505-1R (SEQ ID NOS: 692, 691, 690, 689, 688, 687, 686, 685, 684), MGF505-3R (SEQ ID NOS: 703, 702, 701, 700, 699), EP424R (SEQ ID NOS: 389, 388, 387, 386, 385, 384, 383, 382, 381, 380, 379), C475L (SEQ ID NOS: 201, 200, 199, 198, 197, 196, 195, 194, 193, 192, 191, 190, 189, 188), B602L (SEQ ID NOS: 75, 74, 73, 72, 71, 70, 69, 68, 67), CP530R (SEQ ID NOS: 278, 277, 276, 275), D339L (SEQ ID NOS: 322, 321, 320), D117L (SEQ ID NOS: 862, 864), I243L (SEQ ID NOS: 494, 493, 492, 491), I73R (SEQ ID NOS: 504, 503, 502), DP238L (SEQ ID NOS: 327, 326, 325), I9R (SEQ ID NOS: 513, 512, 511, 510), preferably selected from the group consisting of: MGF505-7R/MGF505-8R (SEQ ID NOS: 774, 772, 724, 722, 721, 719, 717), M448R (SEQ ID NOS: 568, 566, 565, 564, 563), D1133L (SEQ ID NOS: 297, 295, 294, 293, 292, 291, 290, 289, 287, 285, 284, 283, 282, 281), CP312R (SEQ ID NOS: 274, 272, 269, 268, 267), A240L (SEQ ID NOS: 854, 853, 25), A238L (SEQ ID NOS: 23, 21, 19, 17), MGF100-1L (SEQ ID NOS: 572, 570); and most preferably selected from the group consisting of: MGF505-7R/MGF505-8R (SEQ ID NOS: 774, 772, 724, 722, 721, 719, 717), M448R (SEQ ID NOS: 568, 566, 565, 564, 563), D1133L (SEQ ID NOS: 297, 295, 294, 293, 292, 291, 290, 289, 287, 285, 284, 283, 282, 281), CP312R (SEQ ID NOS: 274, 272, 269, 268, 267), A240L (SEQ ID NOS: 854, 853, 25).

75. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: MGF505-7R/MGF505-8R (SEQ ID NOS: 774, 772, 724, 722, 721, 719, 717).

76. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: MGF505-7R (SEQ ID NO: 774).

77. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: MGF505-8R (SEQ ID NO: 772).

78. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: MGF505-7R (SEQ ID NO: 724).

79. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: MGF505-8R (SEQ ID NO: 722).

80. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: MGF505-7R (SEQ ID NO: 721).

81. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: MGF505-7R (SEQ ID NO: 719).

82. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: MGF505-8R (SEQ ID NO: 717).

83. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: M448R (SEQ ID NOS: 568, 566, 565, 564, 563).

84. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: M448R (SEQ ID NO: 568).

85. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: M448R (SEQ ID NO: 566).

86. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: M448R (SEQ ID NO: 565).

87. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: M448R (SEQ ID NO: 564).

88. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: M448R (SEQ ID NO: 563).

89. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NOS: 297, 295, 294, 293, 292, 291, 290, 289, 287, 285, 284, 283, 282, 281).

90. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 297).

91. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 295).

92. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 294).

93. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 293).

94. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 292).

95. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 291).

96. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 290).

97. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 289).

98. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 287).

99. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 285).

100. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 284).

101. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 283).

102. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 282).

103. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 281).

104. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: CP312R (SEQ ID NOS: 274, 272, 269, 268, 267).

105. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: CP312R (SEQ ID NO: 274).

106. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: CP312R (SEQ ID NO: 272).

107. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: CP312R (SEQ ID NO: 269).

108. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: CP312R (SEQ ID NO: 268).

109. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: CP312R (SEQ ID NO: 267).

110. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: A240L (SEQ ID NOS: 854, 853, 25).

111. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: A240L (SEQ ID NO: 854).

112. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: A240L (SEQ ID NO: 853).

113. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: A240L (SEQ ID NO: 25).

114. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: A238L (SEQ ID NOS: 23, 21, 19, 17).

115. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: A238L (SEQ ID NO: 23).

116. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: A238L (SEQ ID NO: 21).

117. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: A238L (SEQ ID NO: 19).

118. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: A238L (SEQ ID NO: 17).

119. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: MGF100-1L (SEQ ID NOS: 572, 570).

120. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: MGF100-1L (SEQ ID NO: 572).

121. The immunogenic composition or the vaccine or pharmaceutical composition as disclosed in clause 74, wherein according to (b) the one, two or more African swine fever virus oligonucleotides and/or polynucleotides and/or immunogenic fragments thereof encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: MGF100-1L (SEQ ID NOS: 570).

122. The immunogenic composition or the vaccine or pharmaceutical composition as disclosed in any one of clauses 24 to 121, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF505-7R/MGF505-8R (SEQ ID NOS: 857, 775, 773, 725, 723, 720, 718), M448R (SEQ ID NOS: 858, 569, 567), D1133L (SEQ ID NOS: 859, 298, 296, 288, 286), CP312R (SEQ ID NOS: 861, 273, 901, 900, 271, 270), A240L (SEQ ID NOS: 860, 27, 26), A238L (SEQ ID NOS: 24, 22, 20, 18), MGF100-1L (SEQ ID NOS: 573, 571), K145R (SEQ ID NOS: 527, 525, 519, 517), B475L (SEQ ID NOS: 866, 867), H339R (SEQ ID NOS: 469, 467, 459, 457), I226R (SEQ ID NOS: 490, 488, 482, 480), CP2475L (p37) (SEQ ID NOS: 868, 869), CP2475L (p150) (SEQ ID NOS: 870, 871), G1211R (SEQ ID NOS: 433, 431, 421, 419), M1249L (SEQ ID NOS: 872, 873), MGF505-9R (SEQ ID NOS: 874, 875), P1192R (SEQ ID NOS: 876, 877), MGF505-1R (SEQ ID NOS: 878, 879), MGF505-3R (SEQ ID NOS: 880, 881), EP424R (SEQ ID NOS: 882, 883), C475L (SEQ ID NOS: 884, 885), B602L (SEQ ID NOS: 886, 887), CP530R (SEQ ID NOS: 888, 889), D339L (SEQ ID NOS: 890, 891), D117L (SEQ ID NOS: 863, 865), I243L (SEQ ID NOS: 892, 893), I73R (SEQ ID NOS: 894, 895), DP238L (SEQ ID NOS: 896, 897), I9R (SEQ ID NOS: 898, 899), preferably selected from the group consisting of: MGF505-7R/MGF505-8R (SEQ ID NOS: 857, 775, 773, 725, 723, 720, 718), M448R (SEQ ID NOS: 858, 569, 567), D1133L (SEQ ID NOS: 859, 298, 296, 288, 286), CP312R (SEQ ID NOS: 861, 273, 901, 900, 271, 270), A240L (SEQ ID NOS: 860, 27, 26), A238L (SEQ ID NOS: 24, 22, 20, 18), MGF100-1L (SEQ ID NOS: 573, 571); and most preferably selected from the group consisting of: MGF505-7R/MGF505-8R (SEQ ID NOS: 857, 775, 773, 725, 723, 720, 718), M448R (SEQ ID NOS: 858, 569, 567), D1133L (SEQ ID NOS: 859, 298, 296, 288, 286), CP312R (SEQ ID NOS: 861, 273, 901, 900, 271, 270), A240L (SEQ ID NOS: 860, 27, 26).

123. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF505-7R/MGF505-8R (SEQ ID NOS: 857, 775, 773, 725, 723, 720, 718).

124. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF505-7R (SEQ ID NO: 857).

125. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF505-7R (SEQ ID NO: 775).

126. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF505-8R (SEQ ID NO: 773).

127. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF505-7R (SEQ ID NO: 725).

128. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF505-8R (SEQ ID NO: 723).

129. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF505-7R (SEQ ID NO: 720).

130. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF505-8R (SEQ ID NO: 718).

131. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: M448R (SEQ ID NOS: 858, 569, 567).

132. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: M448R (SEQ ID NO: 858).

133. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: M448R (SEQ ID NO: 569).

134. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof;

comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: M448R (SEQ ID NO: 567).

135. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: D1133L (SEQ ID NOS: 859, 298, 296, 288, 286).

136. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: D1133L (SEQ ID NO: 859).

137. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: D1133L (SEQ ID NO: 298).

138. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: D1133L (SEQ ID NO: 296).

139. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: D1133L (SEQ ID NO: 288).

140. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: D1133L (SEQ ID NO: 286).

141. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: CP312R (SEQ ID NOS: 861, 273, 901, 900, 271, 270).

142. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: CP312R (SEQ ID NO: 861).

143. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: CP312R (SEQ ID NO: 273).

144. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: CP312R (SEQ ID NO: 901, 271).

145. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: CP312R (SEQ ID NO: 900, 270).

146. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: A240L (SEQ ID NOS: 860, 27, 26).

147. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: A240L (SEQ ID NO: 860).

148. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: A240L (SEQ ID NO: 27).

149. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: A240L (SEQ ID NO: 26).

150. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: A238L (SEQ ID NOS: 24, 22, 20, 18).

151. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: A238L (SEQ ID NO: 24).

152. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: A238L (SEQ ID NO: 22).

153. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: A238L (SEQ ID NO: 20).

154. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: A238L (SEQ ID NO: 18).

155. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF100-1L (SEQ ID NOS: 573, 571).

156. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF100-1L (SEQ ID NO: 573).

157. The immunogenic composition or the vaccine or pharmaceutical composition as disclosed in clause 122, wherein according to (b) the one, two or more African swine fever virus oligonucleotides and/or polynucleotides and/or immunogenic fragments thereof encoding African swine fever virus peptides and/or polypeptides, preferably full-length proteins, and/or immunogenic fragments thereof; comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF100-1L (SEQ ID NO: 571).

158. The immunogenic composition or the vaccine or pharmaceutical composition as disclosed in any one of clauses 24 to 157, wherein according to (c) the viral or bacterial vector is selected from the group consisting of: asfivirus viral vector, avipox virus viral vector, canine morbillivirus viral vector, herpes virus viral vector, varicella virus viral vector, Lawsonia spp., *Salmonella* spp.

159. The immunogenic composition or the vaccine or pharmaceutical composition as disclosed in any one of clauses 24 to 158, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: MGF505-7R/MGF505-8R (SEQ ID NOS: 774, 772, 724, 722, 721, 719, 717), M448R (SEQ ID NOS: 568, 566, 565, 564, 563), D1133L (SEQ ID NOS: 297, 295, 294, 293, 292, 291, 290, 289, 287, 285, 284, 283, 282, 281), CP312R (SEQ ID NOS: 274, 272, 269, 268, 267), A240L (SEQ ID NOS: 854, 853, 25), A238L (SEQ ID NOS: 23, 21, 19, 17), MGF100-1L (SEQ ID NOS: 572, 570), K145R (SEQ ID NOS: 526, 524, 523, 522, 521, 520, 518, 516, 515, 514), B475L (SEQ ID NOS: 66, 65, 64, 63, 62, 61, 60, 59, 58, 57, 56, 55, 54, 53, 52, 51, 50, 49, 48), H339R (SEQ ID NOS: 468, 466, 465, 464, 463, 462, 461, 460, 458, 456, 455, 454), I226R (SEQ ID NOS: 489, 487, 486, 485, 484, 483, 481, 479, 478), CP2475L (p37) (SEQ ID NOS: 266, 265, 264, 263, 262, 261), CP2475L (p150) (SEQ ID NOS: 260, 259, 258), G1211R (SEQ ID NOS: 432, 430, 429, 428, 427, 426, 425, 424, 423, 422, 420, 418, 417, 416), M1249L (SEQ ID NOS: 562, 561, 560, 559, 558, 557, 556, 555, 554, 553, 552, 551, 550, 549, 548, 547, 546, 545, 544, 543, 542, 541, 540, 539), MGF505-9R (SEQ ID NOS: 733, 732, 731, 730, 729, 728, 727, 726), P1192R (SEQ ID NOS: 817, 816, 815, 814, 813, 812, 811, 810, 809, 808, 807, 806, 805, 804, 803, 802, 801), MGF505-1R (SEQ ID NOS: 692, 691, 690, 689, 688, 687, 686, 685, 684), MGF505-3R (SEQ ID NOS: 703, 702, 701, 700, 699), EP424R (SEQ ID NOS: 389, 388, 387, 386, 385, 384, 383, 382, 381, 380, 379), C475L (SEQ ID NOS: 201, 200, 199, 198, 197, 196, 195, 194, 193, 192, 191, 190, 189, 188), B602L (SEQ ID NOS: 75, 74, 73, 72, 71, 70, 69, 68, 67), CP530R (SEQ ID NOS: 278, 277, 276, 275), D339L (SEQ ID NOS: 322, 321, 320), D117L (SEQ ID NOS: 862, 864), I243L (SEQ ID NOS: 494, 493, 492, 491), I73R (SEQ ID NOS: 504, 503, 502), DP238L (SEQ ID NOS: 327, 326, 325), I9R (SEQ ID NOS: 513, 512, 511, 510), preferably selected from the group consisting of: MGF505-7R/MGF505-8R (SEQ ID NOS: 774, 772, 724, 722, 721, 719, 717), M448R (SEQ ID NOS: 568, 566, 565, 564, 563), D1133L (SEQ ID NOS: 297, 295, 294, 293, 292, 291, 290, 289, 287, 285, 284, 283, 282, 281), CP312R (SEQ ID NOS: 274, 272, 269, 268, 267), A240L (SEQ ID NOS: 854, 853, 25), A238L (SEQ ID NOS: 23, 21, 19, 17), MGF100-1L (SEQ ID NOS: 572, 570); and most preferably selected from the group consisting of: MGF505-7R/MGF505-8R (SEQ ID NOS: 774, 772, 724, 722, 721, 719, 717), M448R (SEQ ID NOS: 568, 566, 565, 564, 563), D1133L (SEQ ID NOS: 297, 295, 294, 293, 292, 291, 290, 289, 287, 285, 284, 283, 282, 281), CP312R (SEQ ID NOS: 274, 272, 269, 268, 267), A240L (SEQ ID NOS: 854, 853, 25).

160. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: MGF505-7R/MGF505-8R (SEQ ID NOS: 774, 772, 724, 722, 721, 719, 717).

161. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: MGF505-7R (SEQ ID NO: 774).

162. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: MGF505-8R (SEQ ID NO: 772).

163. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: MGF505-7R (SEQ ID NO: 724).

164. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: MGF505-8R (SEQ ID NO: 722).

165. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: MGF505-7R (SEQ ID NO: 721).

166. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: MGF505-7R (SEQ ID NO: 719).

167. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: MGF505-8R (SEQ ID NO: 717).

168. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: M448R (SEQ ID NOS: 568, 566, 565, 564, 563).

169. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: M448R (SEQ ID NO: 568).

170. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: M448R (SEQ ID NO: 566).

171. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: M448R (SEQ ID NO: 565).

172. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: M448R (SEQ ID NO: 564).

173. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: M448R (SEQ ID NO: 563).

174. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NOS: 297, 295, 294, 293, 292, 291, 290, 289, 287, 285, 284, 283, 282, 281).

175. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 297).

176. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 295).

177. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 294).

178. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 293).

179. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 292).

180. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 291).

181. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 290).

182. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 289).

183. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 287).

184. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 285).

185. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 284).

186. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 283).

187. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 282).

188. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: D1133L (SEQ ID NO: 281).

189. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: CP312R (SEQ ID NOS: 274, 272, 269, 268, 267).

190. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: CP312R (SEQ ID NO: 274).

191. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: CP312R (SEQ ID NO: 272).

192. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: CP312R (SEQ ID NO: 269).

193. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: CP312R (SEQ ID NO: 268).

194. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: CP312R (SEQ ID NO: 267).

195. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: A240L (SEQ ID NOS: 854, 853, 25).

196. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: A240L (SEQ ID NO: 854).

197. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: A240L (SEQ ID NO: 853).

198. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: A240L (SEQ ID NO: 25).

199. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: A238L (SEQ ID NOS: 23, 21, 19, 17).

200. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: A238L (SEQ ID NO: 23).

201. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: A238L (SEQ ID NO: 21).

202. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: A238L (SEQ ID NO: 19).

203. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: A238L (SEQ ID NO: 17).

204. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence selected from the group consisting of: MGF100-1L (SEQ ID NOS: 572, 570).

205. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: MGF100-1L (SEQ ID NO: 572).

206. The immunogenic composition or the vaccine or pharmaceutical composition as disclosed in clause 159, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof; comprising, preferably consisting of, an amino acid sequence which is at least 80%, 85%, 90%, 91%, 92%, 93%, 94%, 95%, 97%, 98%, 99% or 100% identical to an amino acid sequence selected from the group consisting of: MGF100-1L (SEQ ID NOS: 570).

207. The immunogenic composition or the vaccine or pharmaceutical composition as disclosed in any one of clauses 24 to 206, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF505-7R/MGF505-8R (SEQ ID NOS: 857, 775, 773, 725, 723, 720, 718), M448R (SEQ ID NOS: 858, 569, 567), D1133L (SEQ ID NOS: 859, 298, 296, 288, 286), CP312R (SEQ ID NOS: 861, 273, 901, 900, 271, 270), A240L (SEQ ID NOS: 860, 27, 26), A238L (SEQ ID NOS: 24, 22, 20, 18), MGF100-1L (SEQ ID NOS: 573, 571), K145R (SEQ ID NOS: 527, 525, 519, 517), B475L (SEQ ID NOS: 866, 867), H339R (SEQ ID NOS: 469, 467, 459, 457), I226R (SEQ ID NOS: 490, 488, 482, 480), CP2475L (p37) (SEQ ID NOS: 868, 869), CP2475L (p150) (SEQ ID NOS: 870, 871), G1211R (SEQ ID NOS: 433, 431, 421, 419), M1249L (SEQ ID NOS: 872, 873), MGF505-9R (SEQ ID NOS: 874, 875), P1192R (SEQ ID NOS: 876, 877), MGF505-1R (SEQ ID NOS: 878, 879), MGF505-3R (SEQ ID NOS: 880, 881), EP424R (SEQ ID NOS: 882, 883), C475L (SEQ ID NOS: 884, 885), B602L (SEQ ID NOS: 886, 887), CP530R (SEQ ID NOS: 888, 889), D339L (SEQ ID NOS: 890, 891), D117L (SEQ ID NOS: 863, 865), I243L (SEQ ID NOS: 892, 893), I73R (SEQ ID NOS: 894, 895), DP238L (SEQ ID NOS: 896, 897), I9R (SEQ ID NOS: 898, 899); preferably selected from the group consisting of: MGF505-7R/MGF505-8R (SEQ ID NOS: 857, 775, 773, 725, 723, 720, 718), M448R (SEQ ID NOS: 858, 569, 567), D1133L (SEQ ID NOS: 859, 298, 296, 288, 286), CP312R (SEQ ID NOS: 861, 273, 901, 900, 271, 270), A240L (SEQ ID NOS: 860, 27, 26), A238L (SEQ ID NOS: 24, 22, 20, 18), MGF100-1L (SEQ ID NOS: 573, 571); and most preferably selected from the group consisting of: MGF505-7R/MGF505-8R (SEQ ID NOS: 857, 775, 773, 725, 723, 720, 718), M448R (SEQ ID NOS: 858, 569, 567), D1133L (SEQ ID NOS: 859, 298, 296, 288, 286), CP312R (SEQ ID NOS: 861, 273, 901, 900, 271, 270), A240L (SEQ ID NOS: 860, 27, 26).

208. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF505-7R/MGF505-8R (SEQ ID NOS: 857, 775, 773, 725, 723, 720, 718).

209. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF505-7R (SEQ ID NO: 857).

210. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF505-7R (SEQ ID NO: 775).

211. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF505-8R (SEQ ID NO: 773).

212. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF505-7R (SEQ ID NO: 725).

213. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF505-8R (SEQ ID NO: 723).

214. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF505-7R (SEQ ID NO: 720).

215. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF505-8R (SEQ ID NO: 718).

216. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: M448R (SEQ ID NOS: 858, 569, 567).

217. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: M448R (SEQ ID NOS: 858).

218. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: M448R (SEQ ID NO: 569).

219. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: M448R (SEQ ID NO: 567).

220. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: D1133L (SEQ ID NOS: 859, 298, 296, 288, 286).

221. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: D1133L (SEQ ID NO: 859).

222. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: D1133L (SEQ ID NO: 298).

223. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: D1133L (SEQ ID NO: 296).

224. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: D1133L (SEQ ID NO: 288).

225. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: D1133L (SEQ ID NO: 286).

226. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: CP312R (SEQ ID NOS: 861, 273, 901, 900, 271, 270).

227. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: CP312R (SEQ ID NO: 861).

228. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: CP312R (SEQ ID NO: 273).

229. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: CP312R (SEQ ID NO: 901, 271).

230. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: CP312R (SEQ ID NO: 900, 270).

231. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: A240L (SEQ ID NOS: 860, 27, 26).

232. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: A240L (SEQ ID NO: 860).

233. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: A240L (SEQ ID NO: 27).

234. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: A240L (SEQ ID NO: 26).

235. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: A238L (SEQ ID NOS: 24, 22, 20, 18).

236. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: A238L (SEQ ID NO: 24).

237. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: A238L (SEQ ID NO: 22).

238. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: A238L (SEQ ID NO: 20).

239. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: A238L (SEQ ID NO: 18).

240. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF100-1L (SEQ ID NOS: 573, 571).

241. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF100-1L (SEQ ID NO: 573).

242. The immunogenic composition or the vaccine or pharmaceutical composition as disclosed in clause 207, wherein according to (c) the viral or bacterial vector comprises one, two or more African swine fever virus oligonucleotides and/or polynucleotides and/or immunogenic fragments thereof, which encode one, two or more African swine fever virus peptides and/or polypeptides, preferably full-length proteins, and/or immunogenic fragments thereof, wherein the one, two or more African swine fever virus oligonucleotides and/or polynucleotides and/or immunogenic fragments thereof comprise, preferably consist of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF100-1L (SEQ ID NO: 571).

243. The immunogenic composition or the vaccine or pharmaceutical composition as disclosed in any one of clauses 24 to 242, wherein the ASFV polypeptide is an ASFV full-length protein, preferably encoded by a polynucleotide sequence comprising, more preferably consisting of, any possible open reading frame (ORF), even more preferably encoded by a polynucleotide sequence comprising, most preferably consisting of, an open reading frame (ORF) with a 5'-end start codon and a 3'-end stop codon.

244. The immunogenic composition or the vaccine or pharmaceutical composition as disclosed in any of clauses 24 to 243, wherein the African swine fever virus is selected from the group consisting of: BA71, BA71ΔCD2 and/or Georgia2007/1 strain(s).

245. The immunogenic composition or the vaccine or pharmaceutical composition as disclosed in any one of clauses 24 to 244, wherein the immunogenicity (and/or immunological response) of the immunogenic composition or the vaccine or pharmaceutical composition or any comprised immunogenic fragment is indicated/characterized by an induced IFN-gamma response, preferably in a porcine IFN-gamma ELISpot assay, more preferably in a porcine IFN-gamma ELISpot assay as described in Example 1.

246. The immunogenic composition or the vaccine or pharmaceutical composition as disclosed in any one of clauses 24 to 245 for use in a method of reducing or preventing the clinical signs or disease in porcines, preferably a pig, caused by an infection with at least one, preferably pathogenic, African swine fever virus or for use in a method of treating and/or preventing an infection with at least one, preferably pathogenic, African swine fever virus, wherein preferably said clinical signs or disease caused by an infection with at least one, preferably pathogenic, African swine fever virus or said infection with at least one, preferably pathogenic, African swine fever virus are selected from the group consisting of: African swine fever, acute African swine fever, chronic African swine fever, mortality, death, sudden death, fever, high fever, anorexia, lethargy, weakness, loss of appetite, recumbence, erythema, cyanotic skin blotching, diarrhea, constipation, abdominal pain, respiratory signs, coughing, vomiting, dyspnea, nasal and conjunctival discharges, hemorrhages, epistaxis, abortion, leukopenia, thrombocytopenia.

247. The immunogenic composition or the vaccine or pharmaceutical composition as disclosed in any one of clauses 24 to 245 for use in a method of immunizing a porcine, preferably a pig, against a clinical disease caused by at least one, preferably pathogenic, African swine fever virus in said porcine, preferably pig, said method comprising the step of administering to the porcine, preferably pig, the immunogenic composition or the vaccine or pharmaceutical composition as disclosed in any one of clauses 24 to 245, wherein said immunogenic composition or vaccine or pharmaceutical composition fails to cause clinical signs of infection but is capable of inducing an immune response that immunizes the porcine, preferably pig, against, preferably pathogenic forms of, said at least one African swine fever virus, wherein preferably said clinical disease or said clinical signs of infection are selected from the group consisting of: African swine fever, acute African swine fever, chronic African swine fever, mortality, death, sudden death, fever, high fever, anorexia, lethargy, weakness, loss of appetite, recumbence, erythema, cyanotic skin blotching, diarrhea, constipation, abdominal pain, respiratory signs, coughing, vomiting, dyspnea, nasal and conjunctival discharges, hemorrhages, epistaxis, abortion, leukopenia, thrombocytopenia.

248. The immunogenic composition or the vaccine or pharmaceutical composition as disclosed in any one of clauses 24 to 245 for use in a method of prime-boost immunizing a porcine, preferably a pig, against a clinical disease caused by at least one, preferably pathogenic, African swine fever virus in said porcine, preferably pig, said method comprising the step of administering to the porcine, preferably pig, once or twice an immunogenic composition or the vaccine or pharmaceutical composition as disclosed in any one of clauses 24 to 245 comprising (i) one, two or more African swine fever virus oligonucleotides and/or polynucleotides and/or immunogenic fragments thereof as sole immunogenic components or (ii) a viral vector, preferably a recombinant and/or non-naturally occurring viral vector, comprising one, two or more African swine fever virus oligonucleotides and/or polynucleotides and/or immunogenic fragments thereof—as sole immunogenic component (priming step); and subsequently—after priming once or twice—administering to the porcine, preferably pig, a live attenuated African swine fever virus, preferably BA71ΔCD2 (boosting step); wherein said immunogenic composition or vaccine or pharmaceutical composition as well as the live attenuated African swine fever virus independently from each other fail to cause clinical signs of infection but are capable of inducing an immune response that immunizes the porcine, preferably pig, against, preferably pathogenic forms of, said at least one African swine fever virus, wherein preferably said clinical disease or said clinical signs of infection are selected from the group consisting of: African swine fever, acute African swine fever, chronic African swine fever, mortality, death, sudden death, fever, high fever, anorexia, lethargy, weakness, loss of appetite, recumbence, erythema, cyanotic skin blotching, diarrhea, constipation, abdominal pain, respiratory signs, coughing, vomiting, dyspnea, nasal and conjunctival discharges, hemorrhages, epistaxis, abortion, leukopenia, thrombocytopenia.

249. A kit for vaccinating a porcine, preferably a pig, against a disease associated with and/or reducing the incidence or the severity of one or more clinical signs associated with or caused by at least one, preferably pathogenic, African swine fever virus in a porcine, preferably a pig, comprising:
(a) a dispenser capable of administering a vaccine to said porcine; and
(b) the immunogenic composition or the vaccine or pharmaceutical composition as disclosed in any one of clauses 24 to 245, and
(c) optionally, an instruction leaflet;
wherein preferably said disease or said clinical signs are selected from the group consisting of: African swine fever, acute African swine fever, chronic African swine fever, mortality, death, sudden death, fever, high fever, anorexia, lethargy, weakness, loss of appetite, recumbence, erythema, cyanotic skin blotching, diarrhea, constipation, abdominal pain, respiratory signs, coughing, vomiting, dyspnea, nasal and conjunctival discharges, hemorrhages, epistaxis, abortion, leukopenia, thrombocytopenia.

250. An African swine fever virus peptide and/or polypeptide, preferably full-length-protein, and/or immunogenic fragment thereof comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: MGF505-7R/MGF505-8R (SEQ ID NOS: 774, 772, 724, 722, 721, 719, 717), M448R (SEQ ID NOS: 568, 566, 565, 564, 563), D1133L (SEQ ID NOS: 297, 295, 294, 293, 292, 291, 290, 289, 287, 285, 284, 283, 282, 281), CP312R (SEQ ID NOS: 274, 272, 269, 268, 267), A240L (SEQ ID NOS: 854, 853, 25), A238L (SEQ ID NOS: 23, 21, 19, 17), MGF100-1L (SEQ ID NOS: 572, 570), K145R (SEQ ID NOS: 526, 524, 523, 522, 521, 520, 518, 516, 515, 514), B475L (SEQ ID NOS: 66, 65, 64, 63, 62, 61, 60, 59, 58, 57, 56, 55, 54, 53, 52, 51, 50, 49, 48), H339R (SEQ ID NOS: 468, 466, 465, 464, 463, 462, 461, 460, 458, 456, 455, 454), I226R (SEQ ID NOS: 489, 487, 486, 485, 484, 483, 481, 479, 478), CP2475L (p37) (SEQ ID NOS: 266, 265, 264, 263, 262, 261), CP2475L (p150) (SEQ ID NOS: 260, 259, 258), G1211R (SEQ ID NOS: 432, 430, 429, 428, 427, 426, 425, 424, 423, 422, 420, 418, 417, 416), M1249L (SEQ ID NOS: 562, 561, 560, 559, 558, 557, 556, 555, 554, 553, 552, 551, 550, 549, 548, 547, 546, 545, 544, 543, 542, 541, 540, 539), MGF505-9R (SEQ ID NOS: 733, 732, 731, 730, 729, 728, 727, 726), P1192R (SEQ ID NOS: 817, 816, 815, 814, 813, 812, 811, 810, 809, 808, 807, 806, 805, 804, 803, 802, 801), MGF505-1R (SEQ ID NOS: 692, 691, 690, 689, 688, 687, 686, 685, 684), MGF505-3R (SEQ ID NOS: 703, 702, 701, 700, 699), EP424R (SEQ ID NOS: 389, 388, 387, 386, 385, 384, 383, 382, 381, 380, 379), C475L (SEQ ID NOS: 201, 200, 199, 198, 197, 196, 195, 194, 193, 192, 191, 190, 189, 188), B602L (SEQ ID NOS: 75, 74, 73, 72, 71, 70, 69, 68, 67), CP530R (SEQ ID NOS: 278, 277, 276, 275), D339L (SEQ ID NOS: 322, 321, 320), D117L (SEQ ID NOS: 862, 864), I243L (SEQ ID NOS: 494, 493, 492, 491), I73R (SEQ ID NOS: 504, 503, 502), DP238L (SEQ ID NOS: 327, 326, 325), I9R (SEQ ID NOS: 513, 512, 511, 510), preferably selected from the group consisting of: MGF505-7R/MGF505-8R (SEQ ID NOS: 774, 772, 724, 722, 721, 719, 717), M448R (SEQ ID NOS: 568, 566, 565, 564, 563), D1133L (SEQ ID NOS: 297, 295, 294, 293, 292, 291, 290, 289, 287, 285, 284, 283, 282, 281), CP312R (SEQ ID NOS: 274, 272, 269, 268, 267), A240L (SEQ ID NOS: 854, 853, 25), A238L (SEQ ID NOS: 23, 21, 19, 17), MGF100-1L (SEQ ID NOS: 572, 570); and most preferably selected from the group consisting of: MGF505-7R/MGF505-8R (SEQ ID NOS: 774, 772, 724, 722, 721, 719, 717), M448R (SEQ ID NOS: 568, 566, 565, 564, 563), D1133L (SEQ ID NOS: 297, 295, 294, 293, 292, 291, 290, 289, 287, 285, 284, 283, 282, 281), CP312R (SEQ ID NOS: 274, 272, 269, 268, 267), A240L (SEQ ID NOS: 854, 853, 25).

251. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: MGF505-7R/MGF505-8R (SEQ ID NOS: 774, 772, 724, 722, 721, 719, 717).

252. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: MGF505-7R (SEQ ID NO: 774).

253. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: MGF505-8R (SEQ ID NO: 772).

254. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: MGF505-7R (SEQ ID NO: 724).

255. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: MGF505-8R (SEQ ID NO: 722).

256. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: MGF505-7R (SEQ ID NO: 721).

257. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: MGF505-7R (SEQ ID NO: 719).

258. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: MGF505-8R (SEQ ID NO: 717).

259. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: M448R (SEQ ID NOS: 568, 566, 565, 564, 563).

260. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: M448R (SEQ ID NO: 568).

261. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: M448R (SEQ ID NO: 566).

262. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: M448R (SEQ ID NO: 565).

263. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: M448R (SEQ ID NO: 564).

264. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: M448R (SEQ ID NO: 563).

265. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: D1133L (SEQ ID NOS: 297, 295, 294, 293, 292, 291, 290, 289, 287, 285, 284, 283, 282, 281).

266. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: D1133L (SEQ ID NO: 297).

267. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: D1133L (SEQ ID NO: 295).

268. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: D1133L (SEQ ID NO: 294).

269. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: D1133L (SEQ ID NO: 293).

270. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: D1133L (SEQ ID NO: 292).

271. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: D1133L (SEQ ID NO: 291).

272. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: D1133L (SEQ ID NO: 290).

273. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: D1133L (SEQ ID NO: 289).

274. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: D1133L (SEQ ID NO: 287).

275. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: D1133L (SEQ ID NO: 285).

276. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: D1133L (SEQ ID NO: 284).

277. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: D1133L (SEQ ID NO: 283).

278. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: D1133L (SEQ ID NO: 282).

279. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: D1133L (SEQ ID NO: 281).

280. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: CP312R (SEQ ID NOS: 274, 272, 269, 268, 267).

281. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: CP312R (SEQ ID NO: 274).

282. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: CP312R (SEQ ID NO: 272).

283. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: CP312R (SEQ ID NO: 269).

284. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: CP312R (SEQ ID NO: 268).

285. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: CP312R (SEQ ID NO: 267).

286. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: A240L (SEQ ID NOS: 854, 853, 25).

287. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: A240L (SEQ ID NO: 854).

288. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: A240L (SEQ ID NO: 853).

289. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: A240L (SEQ ID NO: 25).

290. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: A238L (SEQ ID NOS: 23, 21, 19, 17).

291. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: A238L (SEQ ID NO: 23).

292. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: A238L (SEQ ID NO: 21).

293. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: A238L (SEQ ID NO: 19).

294. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: A238L (SEQ ID NO: 17).

295. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: MGF100-1L (SEQ ID NOS: 572, 570).

296. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: MGF100-1L (SEQ ID NO: 572).

297. The African swine fever virus peptide and/or polypeptide, preferably full-length-protein, and/or immunogenic fragment thereof as disclosed in clause 250 comprising, preferably consisting of, an amino acid sequence, which is at least 80%, 85%, 90%, 91%, 92%, 93%, 94%, 95%, 97%, 98%, 99% or 100% identical to an amino acid sequence selected from the group consisting of: MGF100-1L (SEQ ID NOS: 570).

298. The African swine fever virus peptide and/or polypeptide, preferably full-length-protein, and/or immunogenic fragment thereof as disclosed in any one of clauses 250 to 297, wherein the African swine fever virus polypeptides, preferably full-length proteins, comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: MGF505-7R/MGF505-8R (SEQ ID NOS: 774, 772, 724, 722), M448R (SEQ ID NOS: 568, 566), D1133L (SEQ ID NOS: 297, 295), CP312R (SEQ ID NOS: 274, 272), A240L (SEQ ID NOS: 854, 853), A238L (SEQ ID NOS: 23, 21), MGF100-1L (SEQ ID NO: 572), K145R (SEQ ID NOS: 526, 524), B475L (SEQ ID NOS: 66, 65), H339R (SEQ ID NOS: 468, 466), I226R (SEQ ID NOS: 489, 487), CP2475 (SEQ ID NO: 257), CP2475 (SEQ ID NO: 256), G1211R (SEQ ID NOS: 432, 430), M1249L (SEQ ID NOS: 562, 561), MGF505-9R (SEQ ID NOS: 733, 732), P1192R (SEQ ID NOS: 817, 816), MGF505-1R (SEQ ID NOS: 692, 691), MGF505-3R (SEQ ID NOS: 703, 702), EP424R (SEQ ID NOS: 389, 388), C475L (SEQ ID NOS: 201, 200), B602L (SEQ ID NOS: 75, 74), CP530R (SEQ ID NOS: 278, 277), D339L (SEQ ID NOS: 322, 321), D117L (SEQ ID NOS: 862, 864), I243L (SEQ ID NOS: 494, 493), I73R (SEQ ID NOS: 504, 503), DP238L (SEQ ID NOS: 327, 326), I9R (SEQ ID NOS: 513, 512) and/or wherein the African swine fever virus peptides and/or immunogenic fragments thereof and/or African swine fever virus polypeptide/full-length protein immunogenic fragments comprise, preferably consist of, an amino acid sequence which is at least 80%, 85%, 90%, 91%, 92%, 93%, 94%, 95%, 97%, 98%, 99% or 100% identical to an amino acid sequence selected from the group consisting of: MGF505-7R/MGF505-8R (SEQ ID NOS: 721, 719, 717), M448R (SEQ ID NOS: 565, 564, 563), D1133L (SEQ ID NOS: 294, 293, 292, 291, 290, 289, 287, 285, 284, 283, 282, 281), CP312R (SEQ ID NOS: 269, 268, 267), A240L (SEQ ID NO: 25), A238L (SEQ ID NOS: 19, 17), MGF100-1L (SEQ ID NO: 570), K145R (SEQ ID NOS: 523, 522, 521, 520, 518, 516, 515, 514), B475L (SEQ ID NOS: 64, 63, 62, 61, 60, 59, 58, 57, 56, 55, 54, 53, 52, 51, 50, 49, 48), H339R (SEQ ID NOS: 465, 464, 463, 462, 461, 460, 458, 456, 455, 454), I226R (SEQ ID NOS: 486, 485, 484, 483, 481, 479, 478), CP2475L (p37) (SEQ ID NOS: 266, 265, 264, 263, 262, 261), CP2475L (p150) (SEQ ID NOS: 260, 259, 258), G1211R (SEQ ID NOS: 429, 428, 427, 426, 425, 424, 423, 422, 420, 418, 417, 416), M1249L (SEQ ID NOS: 560, 559, 558, 557, 556, 555, 554, 553, 552, 551, 550, 549, 548, 547, 546, 545, 544, 543, 542, 541, 540, 539), MGF505-9R (SEQ ID NOS: 731, 730, 729, 728, 727, 726), P1192R (SEQ ID NOS: 815, 814, 813, 812, 811, 810, 809, 808, 807, 806, 805, 804, 803, 802, 801), MGF505-1R (SEQ ID NOS: 690, 689, 688, 687, 686, 685, 684), MGF505-3R (SEQ ID NOS: 701, 700, 699), EP424R (SEQ ID NOS: 387, 386, 385, 384, 383, 382, 381, 380, 379), C475L (SEQ ID NOS: 199, 198, 197, 196, 195, 194, 193, 192, 191, 190, 189, 188), B602L (SEQ ID NOS: 73, 72, 71, 70, 69, 68, 67), CP530R (SEQ ID NOS: 277, 276, 275), D339L (SEQ ID NO: 320), I243L (SEQ ID NOS: 492, 491), I73R (SEQ ID NO: 502), DP238L (SEQ ID NO: 325), I9R (SEQ ID NOS: 511, 510).

299. An African swine fever virus oligonucleotide and/or polynucleotide and/or immunogenic fragment thereof encoding the African swine fever virus peptide and/or polypeptide, preferably full-length-protein, and/or immunogenic fragment thereof as disclosed in any one of clauses 250 to 298.

300. An African swine fever virus oligonucleotide and/or polynucleotide and/or immunogenic fragment thereof encoding African swine fever virus peptides and/or polypeptides, preferably full-length proteins, and/or immunogenic fragments thereof; comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF505-7R/MGF505-8R (SEQ ID NOS: 857, 775, 773, 725, 723, 720, 718), M448R (SEQ ID NOS: 858, 569, 567), D1133L (SEQ ID NOS: 859, 298, 296, 288, 286), CP312R (SEQ ID NOS: 861, 273, 901, 900, 271, 270), A240L (SEQ ID NOS: 860, 27, 26), A238L (SEQ ID NOS: 24, 22, 20, 18), MGF100-1L (SEQ ID NOS: 573, 571), K145R (SEQ ID NOS: 527, 525, 519, 517), B475L (SEQ ID NOS: 866, 867), H339R (SEQ ID NOS: 469, 467, 459, 457), I226R (SEQ ID NOS: 490, 488, 482, 480), CP2475L (p37) (SEQ ID NOS: 868, 869), CP2475L (p150) (SEQ ID NOS: 870, 871), G1211R (SEQ ID NOS: 433, 431, 421, 419), M1249L (SEQ ID NOS: 872, 873), MGF505-9R (SEQ ID NOS: 874, 875), P1192R (SEQ ID NOS: 876, 877), MGF505-1R (SEQ ID NOS: 878, 879), MGF505-3R (SEQ ID NOS: 880, 881), EP424R (SEQ ID NOS: 882, 883), C475L (SEQ ID NOS: 884, 885), B602L (SEQ ID NOS: 886, 887), CP530R (SEQ ID NOS: 888, 889), D339L (SEQ ID NOS: 890, 891), D117L (SEQ ID NOS: 863, 865), I243L (SEQ ID NOS: 892, 893), I73R (SEQ ID NOS: 894, 895), DP238L (SEQ ID NOS: 896, 897), I9R (SEQ ID NOS: 898, 899); preferably selected from the group consisting of: MGF505-7R/MGF505-8R (SEQ ID NOS: 857, 775, 773, 725, 723, 720, 718), M448R (SEQ ID NOS: 858, 569, 567), D1133L (SEQ ID NOS: 859, 298, 296, 288, 286), CP312R (SEQ ID NOS: 861, 273, 901, 900, 271, 270), A240L (SEQ ID NOS: 860, 27, 26), A238L (SEQ ID NOS: 24, 22, 20, 18), MGF100-1L (SEQ ID NOS: 573, 571); and most preferably selected from the group consisting of: MGF505-7R/MGF505-8R (SEQ ID NOS: 857, 775, 773, 725, 723, 720, 718), M448R (SEQ ID NOS: 858, 569, 567), D1133L (SEQ ID NOS: 859, 298, 296, 288, 286), CP312R (SEQ ID NOS: 861, 273, 901, 900, 271, 270), A240L (SEQ ID NOS: 860, 27, 26).

301. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF505-7R/MGF505-8R (SEQ ID NOS: 857, 775, 773, 725, 723, 720, 718).

302. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF505-7R (SEQ ID NO: 857).

303. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF505-7R (SEQ ID NO: 775).

304. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF505-8R (SEQ ID NO: 773).

305. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF505-7R (SEQ ID NO: 725).

306. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF505-8SEQ ID NO:).

307. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF505-7R (SEQ ID NO: 720).

308. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF505-8R (SEQ ID NO: 718).

309. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: M448R (SEQ ID NOS: 858, 569, 567).

310. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: M448R (SEQ ID NO: 858).

311. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: M448R (SEQ ID NO: 569).

312. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: M448R (SEQ ID NO: 567).

313. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: D1133L (SEQ ID NOS: 859, 298, 296, 288, 286).

314. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: D1133L (SEQ ID NO: 859).

315. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: D1133L (SEQ ID NO: 298).

316. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: D1133L (SEQ ID NO: 296).

317. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: D1133L (SEQ ID NO: 288).

318. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: D1133L (SEQ ID NO: 286).

319. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: CP312R (SEQ ID NOS: 861, 273, 901, 900, 271, 270).

320. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: CP312R (SEQ ID NO: 861).

321. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: CP312R (SEQ ID NO: 273).

322. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: CP312R (SEQ ID NO: 901, 271).

323. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: CP312R (SEQ ID NO: 900, 270).

324. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: A240L (SEQ ID NOS: 860, 27, 26).

325. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: A240L (SEQ ID NO: 860).

326. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: A240L (SEQ ID NO: 27).

327. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: A240L (SEQ ID NO: 26).

328. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: A238L (SEQ ID NOS: 24, 22, 20, 18).

329. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: A238L (SEQ ID NO: 24).

330. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: A238L (SEQ ID NO: 22).

331. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: A238L (SEQ ID NO: 20).

332. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: A238L (SEQ ID NO: 18).

333. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF100-1L (SEQ ID NOS: 573, 571).

334. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF100-1L (SEQ ID NO: 573).

335. The African swine fever virus oligonucleotide and/or polynucleotide and/or immunogenic fragment thereof encoding African swine fever virus peptides and/or polypeptides, preferably full-length proteins, and/or immunogenic fragments thereof; as disclosed in clause 300 comprising, preferably consisting of, a nucleic acid sequence which is at least 70%, 75%, 80%, 85%, 90%, 91%, 92%, 93%, 94%, 95%, 97%, 98%, 99% or 100% identical to a nucleic acid sequence selected from the group consisting of: MGF100-1L (SEQ ID NO: 571).

336. The African swine fever virus peptide and/or polypeptide, preferably full-length-protein, and/or immunogenic fragment thereof as disclosed in any one of clauses 250 to 298 or the African swine fever virus oligonucleotide and/or polynucleotide and/or immunogenic fragment thereof encoding African swine fever virus peptide and/or polypeptide, preferably full-length-protein, and/or immunogenic fragments thereof as disclosed in any one of clauses 299 to 335, wherein the immunogenicity (and/or immunological response) of the immunogenic composition or the vaccine or pharmaceutical composition or any comprised immunogenic fragment is indicated/characterized by an induced IFN-gamma response, preferably in a porcine IFN-gamma ELISpot assay, more preferably in a porcine IFN-gamma ELISpot assay as described in Example 1.

337. The African swine fever virus peptide and/or polypeptide, preferably full-length-protein, and/or immunogenic fragment thereof as disclosed in any one of clauses 250 to 298 and 336 or the African swine fever virus oligonucleotide and/or polynucleotide and/or immunogenic fragment thereof encoding African swine fever virus peptide and/or polypeptide, preferably full-length-protein, and/or immunogenic fragments thereof as disclosed in any one of clauses 299 to 336, wherein the ASFV polypeptide is an ASFV full-length protein, preferably encoded by a polynucleotide sequence comprising, more preferably consisting of, any possible open reading frame (ORF), even more preferably encoded by a polynucleotide sequence comprising, most preferably consisting of, an open reading frame (ORF) with a 5'-end start codon and a 3'-end stop codon.

338. A viral or bacterial vector, preferably selected from the group consisting of: asfivirus viral vector, avipox virus viral vector, canine morbillivirus viral vector, herpes virus viral vector, varicella virus viral vector, Lawsonia spp., *Salmonella* spp., comprising one, two, three or more African swine fever virus oligonucleotides and/or polynucleotides and/or immunogenic fragments thereof as disclosed in any one of clauses 299 to 335.

339. A vector, preferably an expression vector, comprising one, two, three or more African swine fever virus oligonucleotides and/or polynucleotides and/or immunogenic fragments thereof as disclosed in any one of clauses 299 to 335.

340. The viral or bacterial vector as disclosed in clause 338 or the vector as disclosed in clause 339 comprising three African swine fever virus oligonucleotides and/or polynucleotides and/or immunogenic fragments thereof, preferably selected from EP402R, CP312R and A240L (multiepitope-I, ME-I), more preferably comprising, most preferably consisting of, the nucleic acid sequence selected from the group consisting of: SEQ ID NO: 855; or comprising thirteen African swine fever virus oligonucleotides and/or polynucleotides and/or immunogenic fragments thereof, preferably selected from D1133L, G1211R, M1249L, MGF505-9R, P1192R, CP2475L (p150), B475L, EP424R, H339R, I226R, K145R, MGF505-1R and CP2475L (p37) (multiepitope-II, ME-II), more preferably comprising, most preferably consisting of, the nucleic acid sequence selected from the group consisting of: SEQ ID NO: 856.

341. A host cell, preferably a mammalian host cell, comprising the viral or bacterial vector or the vector as disclosed in any one of clauses 338 to 340.

342. The immunogenic composition or the vaccine or pharmaceutical composition as disclosed in any one of clauses 24 to 341, wherein the viral or bacterial vector is a genetically modified virus or bacterium, which was manipulated by recombinant DNA technique in a way so that its entry into a host cell results in a specific biological activity, e.g. the expression of a transgene, such as an ASFV gene, carried by the vector, wherein preferably the transgene is an ASFV antigen and wherein preferably the viral or bacterial vector may or may not be replication competent in the target or host cell.

SEQUENCE LISTING (901 sequences)

SEQ ID NO: 1 - protein, 21 aa, African swine fever virus
MAMSIPRMINKRKKRIQFLTF

SEQ ID NO: 2 - protein, 11 aa, African swine fever virus
KRKKRIQFLTF

SEQ ID NO: 3 - protein, 10 aa, African swine fever virus
LTFLTNLFLY

SEQ ID NO: 4 - protein, 60 aa, African swine fever virus
MHSNVSFNFIACVLFPTPLIPSMAMSIPRMINKRKKRIQFLTFLTNLFLYNIVQHCISGI

SEQ ID NO: 5 - protein, 9 aa, African swine fever virus
NSYTKKMEL

SEQ ID NO: 6 - protein, 137 aa, African swine fever virus
MEAVLTKLDQEEKKALQNFHRCAWEETKNIINDFLEIPEERCTYKFNSYTKKMELLFTPEFHTAWHEVPECREFILNFLRLISGHRVVLKGPTFVFTKETKNLGIPSTINVDFQANIENMDDLQKGNLIGKMNIKEG

SEQ ID NO: 7 - protein, 137 aa, African swine fever virus
MEAVLTKLDQEEKKALQNFHRCAWEETKNIINDFLEIPEERCTYKFNSYTKKMELLFTPEFHTAWHEVPECREFILNFLRLISGHRVVLKGPTFVFTKEIKNLGIPSTINVDFQANIENMDDLQKGNLIGKMNIKEG

SEQ ID NO: 8 - protein, 9 aa, African swine fever virus
ENDLYHTNY

SEQ ID NO: 9 - protein, 16 aa, African swine fever virus
VSEISYIGNTYKYFTF

SEQ ID NO: 10 - protein, 10 aa, African swine fever virus
ISYIGNTYKY

SEQ ID NO: 11 - protein, 8 aa, African swine fever virus
NTYKYFTF

SEQ ID NO: 12 - protein, 151 aa, African swine fever virus
MMALLHKEKLIECIENEVLSGGTVLLLVKNIVVSEISYIDNSYKYFTFNANHDLKSKEDLKGATSNNIAKMIYNWIIKNPQNNKIWSGEPRTQIYFENDLYHTNYNHECIKDFWDVSTSVGPCIFNDRSIWCTKCTSFYPFTNIMSPNIFQ

SEQ ID NO: 13 - protein, 158 aa, African swine fever virus
MNKKIIVMMALLHKEKLIECIYHELENGGTILLLTKNIVVSEISYIGNTYKYFTFNDNHDLISKEDLKGATSKNIAKMIYNWIIKNPQNNKIWSGEPRTQIYFENDLYHTNYNHKCIKDFWNVSTSVGPHIFNDRSIWCTKCTSFYPFTNIMSPNIFQ

SEQ ID NO: 14 - protein, 9 aa, African swine fever virus
VIFNIKYFL

SEQ ID NO: 15 - protein, 179 aa, African swine fever virus
MEGEELIYHNIINEILVGYIKYYINDISEHELSPYQQQIKKILTYYDECLNKQVTITFSLTSVQEIKTQFTGVVTELFKDLINWGRICGFIVFSAKMAKYCKDANNHLESTVITTAYNFMKHNLLPWMISHGGQEEFLAFSLHSDMYSVIFNIKYFLSKFCNHMFFRSCVQLLRNCNLI

SEQ ID NO: 16 - protein, 179 aa, African swine fever virus; identical to SEQ ID NO: 15

SEQ ID NO: 17 - protein, 11 aa, African swine fever virus
DKDGNSALHYL

SEQ ID NO: 18 - DNA, 33 bp, African swine fever virus
gataaagatggaaactctgctttacattattta

SEQ ID NO: 19 - protein, 11 aa, African swine fever virus
DKDGNSALHYL

SEQ ID NO: 20 - DNA, 33 bp, African swine fever virus; identical to SEQ ID NO: 18

SEQ ID NO: 21 - protein, 238 aa, African swine fever virus
MEHMFPEREIENLFVKWIKKHIRNGNLTLFEEFFKTDPWIVNRCDKNGSSVFMWICIYGRIDFLKFLFEQESYPGEIINPHRRDKDGNSALHYLAEKKNHLILEEVLGYFGKNGTKICLPNFNGMTPVMKAAIRGRTSNVLSLIKFGADPTQKDYHRGFTAWDWAVFTGNMELVKSLNHDYQKPLYMHFPLYKLDVFHRWFKKKPKIIITGCKNNVYEKLPEQNPNFLCVKKLNKYGK

SEQ ID NO: 22 - DNA, 717 bp, African swine fever virus
atggaacacatgtttccagaaagggagatagaaaacttgtttgttaaatggattaaaaaacatatcagaaatggaaatcttacactatttgaggaattttttaaaacagatccgtggattgtcaatagatgcgataaaaatggatcctcggtattcatgtggatatgcatctacggacgtatagactttttaaaatttctttttgaacaagaatcttatcccggagaaataattaaccctcataggagggataaagatggaaactctgctttacattatttagctgagaaaaaaaatcatttaatcctggaagaggtgttgggctatttcggaaaaaatgggaccaaaatttgtttaccgaattttaatgggatgactcctgtgatgaaggccgcaatacggggccgtacttcaaatgtgctttctctcataaaatttggagcagatccgactcaaaaagactatcatagaggctttactgcttgggactgggcagtctttacaggaaatatggagttagtcaaatctcttaaccatgactaccaaaaacctctctacatgcatttccctctttacaagctggatgttttccaccggtggtttaagaaaaagcccaaaattattattactggctgtaaaaataatgtctatgaaaaacttcctgaacagaatccaaacttcctgtgtgtaaaaaaactgaacaagtatggaaagtaa

SEQ ID NO: 23 - protein, 226 aa, African swine fever virus
MFPEREIENLFVKWIKKHIRNGNLTLFEEFFKTDPWIVNRCDKNGSSVFMWICIYGRIDFLKFLFEQESYPGEIINPHRRDKDGNSALHYLAEKKNHLILEGVLGYFGKNGTRICLPNFNGMTPVMKAAIRGRSLNMLSLIKFGADPTQKDYHRGFTAWDWAVFTGNMELVKSLNHDYQNLSTCISLFTSWMFSTGGLRKSPKLLLLAVNIMSMKNFLNRIQSSCV

SEQ ID NO: 24 - DNA, 681 bp, African swine fever virus
atgtttccagaaagggagatagaaaacttgtttgttaaatggattaaaaaacatattagaaatgggaatcttacactatttgaggaattttttaaaacagatccgtggattgtcaatagatgcgataaaaatggatcctcggtattcatgtggatatgcatctacggacgtatagactttttaaaatttctttttgaacaagaatcttatcctggagaaataattaaccctcataggagggataaagatggaaactctgctttacattatttagctgagaaaaaaaatcatttaatcctggaaggggtgttgggctatttcggaaaaaatgggaccagaatttgtttaccgaattttaatgggatgactcctgtgatgaaggccgcaatacggggccgttctttaaatatgctttctctcataaaatttggagcagatccgactcaaaaagactatcatagaggttttactgcttgggactgggcagtctttacaggaaacatggagttagtcaaatctcttaaccatgactaccaaaacctctctacatgcatttccctctttacaagctggatgttttccaccggtggtttaagaaaaagcccaaaattattattactggctgtaaacataatgtctatgaaaaacttcctgaacagaatccaaagttcctgtgtgtaa

SEQ ID NO: 25 - protein, 11 aa, African swine fever virus
SEFIAEIAVLL

SEQ ID NO: 26 - DNA, 33 bp, African swine fever virus
agtgaatttatcgcagaaattgcagtgctactt

SEQ ID NO: 27 - DNA, 711 bp, African swine fever virus
atgcgtggaatactcattgccatcgagggaatcaatggtgtgggaaaaagcacacaggcaatgaaattaaaagaaacattggaatgcatggattataatgctatatgtatacattttcctaatccagacacgaccaccggtgatcttatattgcaggtgttaaataaaaccatagaaatgtcatcggaacaattacataaattatttacaaaacatcgtagtgaatttatcgcagaaattgcagtgctacttaagctaaattatattgtaatagtggaccgttatatttggtctggtttagtatatgctcaagcagatggaatcacgattgaaaccaaaaatacctttaaaccagattatacattctttttatcttcaaagaaaccattgaacgagaaacctttaaccttacaacgtttatttgaaacaaaagaaaaacaagaaacaatttttactaattttactattatcatggatgatgtacctaaaaataggttttgtattattccggcaactcttaataaggaaattattcatatgataattttaacaaaaacgctaaaagtttttgacaacaactcatgtttaaattatattaaaatgtacgatgataagtatttaaatgtccaggatctgaatttattcgatttcgattggcaaaaatatattgaagataataacgataaagaagaatatgactttatagtttag

SEQ ID NO: 28 - protein, 9 aa, African swine fever virus
QLARHAIRY

SEQ ID NO: 29 - protein, 11 aa, African swine fever virus
ATLRFDTWYKW

SEQ ID NO: 30 - protein, 858 aa, African swine fever virus
MCAGFYVAVHPWLEAQSLHKVGHTGNLAARLHDGSYTTCFTDEWKYCFTLETSTKKDAQKIEAGVLYCAQFFRVKNKELVCLLPEKIKQLAEDVANCLDISYTLCDSPAYEMNDSTIVVEPSLPSDPLISKEKLRHLVITPVEDEHFADDVLFFSTDETRTAIEDRLYQKEAANMGYQELRRSGRAILQMACRCGKTRVAYLILSNYLQGKVLYLVPGLSLLRQTLEKLYQYGISLKNVLLVGSDQTRIVLNHDNIEMTTNPVFIAKRIREAPSLLVIATYQSSTLLVDDFDLIISDECHRICGEWETRPFTHVLLNFKKGHRLFLTATPRYDTPLSMKNRELFGGVAFRYYLREGIEAGYVNDFELQMVAAPKLAHQPSTKEETTKQIIVKQIIMALAYLKTNIPAPKMLVFTRDIKQAKELYAALVDQGVYALIAHSTLPRQVILKTFTEFCSSKEPVILLNCRLFQEGVEVPELNAVFFAAPRHSPRDIIQSICRPLNKQVQKPHATIFLPLEVNTENVCLDRFSSIIPFADALASEDPRFYEHLLNPSEVAYPINWIGAHGSVSELLQLARHAIRYGTQGKIDRLTRSERLPWKAAFAELKRTVEICCRYPKINDGFHFGGATLRFDTWYKWVIKSYLQYKNKEPSSLEPYQVSDLESLQDWTTRGVGGPYPWEESMAFLETWLAQNKGELVAIDIHQGGWIGLDATPMERLSGVLTTVSQRDGRSYGKNKKLRPKKGFMIPPQQAQDLDRIFGKHNLKWRKDRVNGFLKEDEHGNYTGEPTCIQEAYRTFKEYVKTNPEYIEKYWPGYAKGKHKHQELPHIWEKGLAPPRYKAFKDGNKQLIQRSPKKKDIKN

SEQ ID NO: 31 - protein, 9 aa, African swine fever virus
LTRHIYNTV

SEQ ID NO: 32 - protein, 117 aa, African swine fever virus
MGYTIQLDKDGDYCWDEDPTHHDPYMQANATSHVATSYATTSHAAVAAPHAAAHHTFHEPFIKLNLTDKNIFNGLGFILIVIFIYLLLITLQQMLTRHIYNTVQHCVKAHLDSKNLQ

SEQ ID NO: 33 - protein, 115 aa, African swine fever virus
MGYTIQLDKDGDYCWDEDPTHHDPYMQANATSHVATSYATTSHAATPHAAAHHTFHEPFIKLNLTDKNIFNGLGFILIVIFIYLLLITLQQMLTRHIYNTVQHCVKAHLDSKNLQ

SEQ ID NO: 34 - protein, 8 aa, African swine fever virus
FQYWTFAF

SEQ ID NO: 35 - protein, 119 aa, African swine fever virus
MLHWGPKYWRSLHLYAIFFSDAPSWKEKYEAIQWILNFIESLPCTRCQHHAFSYLTKNPLTLNNSEDFQYWTFAFHNNVNNRLNKKIISWSEYKNIYEQSILKTIEYGKTDFIGAWSSL

SEQ ID NO: 36 - protein, 10 aa, African swine fever virus
AKDLDNNKEL

SEQ ID NO: 37 - protein, 9 aa, African swine fever virus
NKKEEYLRM

SEQ ID NO: 38 - protein, 125 aa, African swine fever virus
MAVYAKDLDNNKELNQKLINDQLKIIDTLLLAEKKNFLVYELPAPFDFSSGDPLASQRDIYYAIIKSLEERGFTVKICMKGDRALLFITWKKIQSIEINKKEEYLRMHFIQDEEKAFYCKFLESR

SEQ ID NO: 39 - protein, 125 aa, African swine fever virus; identical to SEQ ID NO: 38

SEQ ID NO: 40 - protein, 9 aa, African swine fever virus
FQNPFIVAL

SEQ ID NO: 41 - protein, 164 aa, African swine fever virus
MNVDFIAGINNLGEKIYTCEPFKTSFQNPFIVALIITAVVLVVFFAICNPPVDKKRKTKTAIYVYICIVALLFLHYYVLNHQLNDIYNKSNMDVIVSSIHDKYKGGDEIIPPISPPSVSNELEEDQPKKIPAGPKPADSKPVSLPDSKPLVPLQEVIMPSQYNN

SEQ ID NO: 42 - protein, 10 aa, African swine fever virus
KTVPKFVPTY

SEQ ID NO: 43 - protein, 175 aa, African swine fever virus
METNCPNILYLSGITIEECLQSKKTATDTLNTNDDEAEVEKKLPSVFTTVSKWVTHSSFKCWTCHLYFKTVPKFVPTYMRENERGEIEMGVLGNFCSFSCAASYVDVHYTEPKRWEARELLNMLYRFFTSQWISYIKPAPSYTMRKEYGGKLSEEAFISELHTLEESISSKHIFI

SEQ ID NO: 44 - protein, 8 aa, African swine fever virus
AQMSALAL

SEQ ID NO: 45 - protein, 318 aa, African swine fever virus
MLHLIYISIIVVLIIILISYTRKPKYFRITAPRSVALFHGIHPLNPKNYKTFSEEFETILNNAIEDGDFKGQLTEPCSYALRGGKYIRPIILMEIVRACQLQHSFGAPIYPAEAALAAEYFHVASLIIDDMPSFDNDVKRRNKDTVWARFGVAKAQMSALALTMQGFQNICRQIDWIKEHCPRFPDPNQLGALLCTFVSHSLNSAGSGQLVDTPEKTIPFFKIAFIMGWVLGTGSVEDIGMIERAAHCFGHAFQLADDIKDHDTDTGWNYAKIHGKQKTFDDVAQSLQECKKILHGKKIFTSIWNEIFQKVINVALGT

SEQ ID NO: 46 - protein, 9 aa, African swine fever virus
TIFDETHFY

SEQ ID NO: 47 - protein, 385 aa, African swine fever virus
MDEIINKYQAVEKLFKEIQQGLAAYDQYKTLISEMMHYNNHIKQEYFNFLMIISPYLIRAHSGETLRNKVNNEIKRLILVENINTKISKTLVSVNFLLQKKLSTDGVKTKNMWCTNNPMLQVKTAHNLFKQLCDTQSKTQWVQTLKYKECKYCHTDMVFNTTQFGLQCPNCGCIQELMGTIFDETHFYNHDGQKAKSGIFNPNRHYRFWIEHILGRNPEQELGTKQDPCGTKVLQQLKKIIKRDNKCIALLTVENIRKMLKEINRTDLNNCVSLILRKLTGVGPPQISESILLRGEYIFTEAIKIREKVCKKGRINRNYYPYYIYKIFDAILPPNDTTNRRILQYIHLQGNDTLANNDSEWESICMELPEIKWKPTDRTHCVHFF

SEQ ID NO: 48 - protein, 12 aa, African swine fever virus
DSFIPKEYSQSI

SEQ ID NO: 49 - protein, 12 aa, African swine fever virus
LPFIIKNRKENY

SEQ ID NO: 50 - protein, 11 aa, African swine fever virus
LPSEHFSNEEY

SEQ ID NO: 51 - protein, 9 aa, African swine fever virus
NKKLYEKML

SEQ ID NO: 52 - protein, 11 aa, African swine fever virus
RKQELLTSQEL

SEQ ID NO: 53 - protein, 11 aa, African swine fever virus
SQELTSKSPNN

SEQ ID NO: 54 - protein, 9 aa, African swine fever virus
NKKLYEKML

SEQ ID NO: 55 - protein, 12 aa, African swine fever virus
DSFIPKEYSQSI

SEQ ID NO: 56 - protein, 12 aa, African swine fever virus
LPFIIKNRKENY

SEQ ID NO: 57 - protein, 11 aa, African swine fever virus
LPSEHFSNEEY

SEQ ID NO: 58 - protein, 11 aa, African swine fever virus
RKQELLTSQEL

SEQ ID NO: 59 - protein, 11 aa, African swine fever virus
SQELTSKSPNN

SEQ ID NO: 60 - protein, 9 aa, African swine fever virus
SIFETLGAY

SEQ ID NO: 61 - protein, 11 aa, African swine fever virus
TLGAYFINIFY

SEQ ID NO: 62 - protein, 15 aa, African swine fever virus
TLGAYFINIFYNFLY

SEQ ID NO: 63 - protein, 11 aa, African swine fever virus
YFINIFYNFLY

SEQ ID NO: 64 - protein, 9 aa, African swine fever virus
KMLDSFYKY

SEQ ID NO: 65 - protein, 475 aa, African swine fever virus
MDQEESHVISIFETLGAYFINIFYNFLYKNALYKKHSIVTEYQYQVKGYILGVKQNKKLYEKMLDSFYKYFCNITQINSKTLNFSNFITTIVDSFIPKEYSQSISLEKKESILELLLCDYISNLGTFITTEKMLPFIIKNRKENYHKVTKEMQDYSLTFLLKKRMELYNKFLRKQAYVEPETELEETYARLSSYNRSLLHQIEELTSEKKSLLADLSTLRKKYEKRQSEYRRLVQLLYQQIQRSSTSKSSYPLTKFIETLPSEHFSNEEYQKETPADQKEVVEMELLRKQELLTSQELTSKSPNNYPVPHSRTIVSKPPDNYPVPRSRTTTKLDFDNSLQNQELHTKNGFSEKDIVEFGQDKPEEENILAIDQDKPEEENILAIKQDIPEEENILAIDQDKPEFNQDTPEFKEAVLDTKENILEEENQDEPIVQNPFLENFWKPEQKTFNQSGLFEESSNFSNDWSGGDVTLNFS

SEQ ID NO: 66 - protein, 475 aa, African swine fever virus
MDQEESHVISIFETLGAYFINIFYNFLYKNALYKKHSIVTEYQYQVKGYILGVKQNKKLYEKMLDSFYKYFCNITQINSKTLNFSNFVTTIVDSFIPKEYSQSISLEKKESILELLLCDYISNLGTFITTEKMLPFIIKNRKENYHKVTKEMQDYSLTFLLKKRMELYNKFLRKQAYVEPETELEETYARLSSYNRSLLHQIEELTSENKSLLADLSTLRKKYEKRQSEYRRLVQLLYQQIQRSSTSKSSYPLTKFIETLPSEHFSNEEYQKETPADQKEVVEMELLRKQELLTSQELTSKSPNNYPVPHSRTIVSKPLDNYPVPRSRTTTKIDFDNSLQNQELHTKNGFSEKDIVEFGQDKPEEENILAIDQDKPEEETILAIKQDISEEDNIFAIDQDKPEFNQDTPEFKEAVLDIKENILEEENQDEPIVQNPFLENFWKPEQKTFNQSGLFEESSNFSNDWSGGDVTLNFS

SEQ ID NO: 67 - protein, 9 aa, African swine fever virus
KVDEFYYKY

SEQ ID NO: 68 - protein, 11 aa, African swine fever virus
SKPTHTTKTLL

SEQ ID NO: 69 - protein, 8 aa, African swine fever virus
VDEFYYKY

SEQ ID NO: 70 - protein, 24 aa, African swine fever virus
REQYIRRLIMTSFIGYVFKALQEW

SEQ ID NO: 71 - protein, 9 aa, African swine fever virus
LIMTSFIGY

SEQ ID NO: 72 - protein, 11 aa, African swine fever virus
LIMTSFIGYVF

SEQ ID NO: 73 - protein, 9 aa, African swine fever virus
ALQEWMPSY

SEQ ID NO: 74 - protein, 602 aa, African swine fever virus
MAEFNIDELLKNVLEDPSTEISEETLKQLYQRTNPYKQFKNDSRVAFCSFTNLREQYIRRLIMTSFIGYVFKALQEWMPSYSKPTHTTKTLLSELITLVDTLKQETNDVPSESVVNTILSIADSCKTQTQKSKEAKTTIDSFLREHFVFDPNLHAQSAYTCASTCADTNVDTCASTCASTCASTCASTGASTCADTNVDTCASTCADTNVDTCASTCADTNVDTCASTCADTNVDTCASTCADTNVNTCASMCADTNVDTCASTCANTCASTEYTDLADPERIPLHIMQKTLNVPNELQADIDAITQTPQGYRAAAHILQNIELHQSIKHMLENPRAFKPILFNTKITRYLSQHIPPQDTFYKWNYYIEDNYEELRAATESIYPEKPDLEFAFIIYDVVDSSNQQKVDEFYYKYKDQIFSEVSSIQLGNWTLLGSFKANRERYNYFNQNNEIIKRILDRHEEDLKIGKEILRNTIYHKKAKNIQETGPDAPGLSIYNSTFHTDSGIKGLLSFKELKNLEKASGNIKKAREYDFIDDCEEKIKQLLSKENLTPDEESELIKTKKQLNNALEMLNVPDDTIRVDMWVNNNNKLEKEILYTKAEL

SEQ ID NO: 75 - protein, 530 aa, African swine fever virus
MAEFNIDELLKNVLEDPSTEISEETLKQLYQRTNPYKQFKNDSRVAFCSFTNLREQYIRRLIMTSFIGYVFKALQEWMPSYSKPTHTTKTLLSELITLVDTLKQETNDVPSESVVNTILSIADSCKTQTQKSKEAKTTIDSFLREHFVFDPNLHAQSAYTCADTNVDTCASMCADTNVDTCASMCADTNVDTCASTCTSTEYTDLADPERIPLHIMQKTLNVPNELQADIDAITQTPQGYRAAAHILQNIELHQSIKHMLENPRAFKPILFNTKITRYLSQHIPPQDTFYKWNYYIEDNYEELRAATESIYPEKPDLEFAFIIYDVVDSSNQQKVDEFYYKYKDQIFSEVSSIQLGNWTLLGSFKANRERYNYFNQNNEIIKRILDRHEEDLKIGKEILRNTIYHKKAKNIQETGPDAPGLSIYNSTFHTDSGIKGLLSFKELKNLEKASGNIKKAREYDFIDDCEEKIKQLLSKENLTPDEESELIKTKKQLDNALEMLNVPDDTIRVDMWVNNNNKLEKEILYTKAEL

SEQ ID NO: 76 - protein, 13 aa, African swine fever virus
LLQNGSAVLRYST

SEQ ID NO: 77 - protein, 12 aa, African swine fever virus
LQNGSAVLRYST

SEQ ID NO: 78 - protein, 11 aa, African swine fever virus
NVRFDVNGNSL

SEQ ID NO: 79 - protein, 10 aa, African swine fever virus
KPYVPVGFEY

SEQ ID NO: 80 - protein, 11 aa, African swine fever virus
LMSALKWPIEY

SEQ ID NO: 81 - protein, 9 aa, African swine fever virus
SALKWPIEY

SEQ ID NO: 82 - protein, 646 aa, African swine fever virus
MASGGAFCLIANDGKADKIILAQDLLNSRISNIKNVNKSYGKPDPEPTLSQIEETHLVHFNAHFKPYVPVGFEYNKVRPHTGTPTLGNKLTFGIPQYGDFFHDMVGHHILGACHSSWQDAPIQGTAQMGAHGQLQTFPRNGYDWDNQTPLEGAVYTLVDPFGRPIVPGTKNAYRNLVYYCEYPGERLYENVRFDVNGNSLDEYSSDVTTLVRKFCIPGDKMTGYKHLVGQEVSVEGTSGPLLCNIHDLHKPHQSKPILTDENDTQRTCSHTNPKFLSQHFPENSHNIQTAGKQDITPITDATYLDIRRNVHYSCNGPQTPKYYQPPLALWIKLRFWFNENVNLAIPSVSIPFGERFITIKLASQKDLVNEFPGLFIRQSRFIPGRPSRRNIRFKPWFIPGVINEISLTNNELYINNLFVTPEIHNLFVKRVRFSLIRVHKTQVTHTNNNHHDEKLMSALKWPIEYMFIGLKPTWNISDQNPHQHRDWHKFGHVVNAIMQPTHHAEISFQDRDTALPDACSSISDISPVTYPITLPIIKNISVTAHGINLIDKFPSKFCSSYIPFHYGGNAIKTPDDPGAMMITFALKPREEYQPSGHINVSRAREFYISWDTDYVGSITTADLVVSASAINFLLLQNGSAVLRYST

SEQ ID NO: 83 - protein, 646 aa, African swine fever virus
MASGGAFCLIANDGKADKIILAQDLLNSRISNIKNVNKSYGKPDPEPTLSQIEETHLVHFNAHFKPYVPVGFEYNKVRPHTGTPTLGNKLTFGIPQYGDFFHDMVGHHILGACHSSWQDAPIQGTSQMGAHGQLQTFPRNGYDWDNQTPLEGAVYTLVDPFGRPIVPGTKNAYRNLVYYCEYPGERLYENVRFDVNGNSLDEYSSDVTTLVRKFCIPGDKMTGYKHLVGQEVSVEGTSGPLLCNIHDLHKPHQSKPILTDENDTQRTCSHTNPKFLSQHFPENSHNIQTAGKQDITPITDATYLDIRRNVHYSCNGPQTPKYYQPPLALWIKLRFWFNENVNLAIPSVSIPFGERFITIKLASQKDLVNEFPGLFVRQSRFIAGRPSRRNIRFKPWFIPGVINEISLTNNELYINNLFVTPEIHNLFVKRVRFSLIRVHKTQVTHTNNNHHDEKLMSALKWPIEYMFIGLKPTWNISDQNPHQHRDWHKFGHVVNAIMQPTHHAEISFQDRDTALPDACSSISDISPVTYPITLPIIKNISVTAHGINLIDKFPSKFCSSYIPFHYGGNAIKTPDDPGAMMITFALKPREEYQPSGHINVSRAREFYISWDTDYVGSITTADLVVSASAINFLLLQNGSAVLRYST

SEQ ID NO: 84 - protein, 8 aa, African swine fever virus
FQHAIVYF

SEQ ID NO: 85 - protein, 962 aa, African swine fever virus
MGKPTLLEPGHLYNVPAEHKNDVPIHYIITWIKQRLPEFGGAIPTSLADRVLIIKSRTGSGKSTALPVHVFRILRNENTHSFQKYLGRSVICTQPRVLTAVTLAKDIGASTHYPDMILGQTVGYQTKPLTEKPNRGLIYATAGVLLAQLHTMTDDEIASRYAFMIIDEAHERALGIDLMLMYIKSMLQRMLQRGSIGALRIPFVILTSATIDTHKYSTYFGIGKENIILVEGRQYGVETHWPLYNTNNYIKTACETALTIHKENIHDRPTEADILIFMPGMAEIRFLSMLLNNANMDLAKEKLPLMLILPIDSEAIAQENEAYLGLKAEIKNLWVKNPLTAKVEKPLRRVIVSTVVAETGLTIETLKYVIDPGWNRSIETYYPEWAGGLITRPAAQSRIEQRKGRVGRVFPGHFYPLYTKHVFEQIPVQQYPEIITEGPGAIFLSIVVETIKKNKEGVFKAEEIDMLDPPPTDALASAIERAIVAGLLTRGEKGLQLTQLGDIASRFSFLSIEEARMCFSGYFWQAAISDIATILAVVSVADKKLTNLLDSKQRNGAMLAEAVLAGIPPFLQNIDNAYTNIHLLLADDLLEGLFIFEGFQHAIVYFINNKVNNVAKHLREWCEKKMLKYSSMVQILARREDILNELAIVGLNPFHQWQNRLASANAETFLKRVCTLKQCMYEAYRLNCFCYDEHRLLYTGRNGIHFSYHDAVIKNPSCIVTPRIMLSPVSKQYMEWRLEPSFVSVLDGFVNVDINFLLPRQEIPNILGGVENEEEEPPLPIQVFLHKYVKTHFHFSGKSFKELKMKPSQMIKFPETTLINMIPDIPKNVVQTYLEINVCHRYSFKRLIYCETFYTDMDDVQHENSVELIGLPMAAHHLTINDFNKLYHLLKPDGFLIMYDLHQGQEAFWLHSLQDALGHHTIRRDMDFHTIPEWETIFKECGFTPIFSKQPSEHELFIVFKK

SEQ ID NO: 86 - protein, 104 aa, African swine fever virus
MSTKKKPTITKQELYSLVAADTQLNKALIERIFTSQQKIIQNALKHNQEVIIPPGIKFTVVTVKAKPARQGHNPATGEPIQIKAKPEHKAVKIRALKPVHDMLN

SEQ ID NO: 87 - protein, 104 aa, African swine fever virus; identical to SEQ ID NO: 86

SEQ ID NO: 88 - protein, 118 aa, African swine fever virus
MHSNAFFNLIACVLFPTPLIPSMVISIPRMINKWVKRVQFLTFLTNLFLYNIVQHYINRIRCYSFIKYLLLYNLYRPIFGRSLQMAITKIKIISDATAAVLLKSCAAMYDVLIDKKFK

SEQ ID NO: 89 - protein, 60 aa, African swine fever virus; identical to SEQ ID NO: 4

SEQ ID NO: 90 - protein, 137 aa, African swine fever virus; identical to SEQ ID NO: 6

SEQ ID NO: 91 - protein, 137 aa, African swine fever virus; identical to SEQ ID NO: 7

SEQ ID NO: 92 - protein, 179 aa, African swine fever virus; identical to SEQ ID NO: 15

SEQ ID NO: 93 - protein, 179 aa, African swine fever virus; identical to SEQ ID NO: 15

SEQ ID NO: 94 - protein, 224 aa, African swine fever virus
MFPKINTIDPYISLRLFEVKPKYVGYSSIDARNQSFAIHGIKNYEKFSNAGFFYTSPTEITCYCCGMKFCNWLYEKHPLQVHGFWSRNCGFMRATLGIIGLKKMIDSYNDYYNNEVFVKHKNRVYTHKRLEDMGFSKPFMRFILANAFIPPYRKYIHKIILNERYFTFKFAAHLLSFHKVNLDNQTTYCMTCGIEPIKKDENFCNACKTLNYKHYKTLNFSVKL

SEQ ID NO: 95 - protein, 224 aa, African swine fever virus
MFPKINTIDPYISLRLFEVKPKYVGYSSIDARNQSFAIHDIKNYEKFSNAGLFYTSPTEITCYCCGMKFCNWLYEKHPLQVHAFWSRNCGFMRATLGIIGLKKMIDSYNDYYNNEVFVKHQNRVYTHKRLEDMGFSKPFMRFILANAFIPPYRKYIHKIILNERYFTFKFAAHLLSFHKVNLDNQTTYCMTCGIEPIKKDENFCNACKTLNYKHYKTLNFSVKL

SEQ ID NO: 96 - protein, 238 aa, African swine fever virus; identical to SEQ ID NO: 21

SEQ ID NO: 97 - protein, 226 aa, African swine fever virus; identical to SEQ ID NO: 23

SEQ ID NO: 98 - protein, 859 aa, African swine fever virus
MCAGFYVAVHPWLEAQSLHKVGHTGNLAARLHDGSYTTCFTDEWKYCFTLETSTKKDAQKIEAGVLYCAQFFRVKNKELVCLLPEKIKQLAEDVANCLDISYTLCDSPTYEMNDSTIVVEPSLPSDPLISKEKLRHLVITPVEDEEHFADDVLFFSTDETRTAIEDRLYQKEAANMGYQELRRSGRAILQMACRCGKTRVAYLILSNYLQGKVLYLVPGLSLLRQTLEKLYQYGISLKNVLLVGSDQTRIVLNHDNIEMTTNPVFIAKRIREAPSLLVIATYQSSTLLVDDFDLIISDECHRICGEWETRPFTHVLLNFKKGHRLFLTATPRYDTPLSMKNRELFGGVAFRYYLREGIEAGYVNDFELQMVAAPKLAHQPSNREETTKQIIVKQIIMALAYLKTNIPAPKMLVFTRDIKQARELYAELVDQGVYALIAHSTLPRQVILKTFTEFCSSKEPVILLNCRLFQEGVEVPELNAVFFAAPRHSPRDIIQSICRPLNKQVQKPHATIFLPLEVNTENVCLDRFSSIIPFADALASEDPRFYEHLLNPSEVAYPINWIGAHGSVSELLQLARHAIRYGTQGKIDRLTRSERLPWKAAFAELKRTVEICCRYPKINDGFHFGGATLRFDTWYKWVIKSYLQYKNKEPSSLEPYQVSDLESLQDWTTRGVGGPYPWEESMAFLETWLAQNKGELVAIDIHQGGWIGLDATPMERLSGVLTTVSQRDGRSYGKNKKLRPKKGFMIPPQQAEDLDRIFGKHNLKWRKDRVNGFLKEDEHGNYTGEPTCIQEAYRTFKEYVKTNPEYIEKYWPGYAKGKHKHQELPHIWESGLAPPRYKAFKDGNKQLIQRSPKKKDIKN

SEQ ID NO: 99 - protein, 858 aa, African swine fever virus; identical to SEQ ID NO: 30

SEQ ID NO: 100 - protein, 175 aa, African swine fever virus
METNCPNILYLSGITIEECLQTKKTATDTLNTNDDEAEVEKKLPSVFTTVSKWVTHSSFKCWTCHLYFKTVPKFVPTYMRENERGEIEMGVLGNFCSFSCAASYVDVHYTEPKRWEARELLNMLYRFFTSQWISYIKPAPSYTMRKEYGGKLSEEAFISELHTLEESISSKHIFI

SEQ ID NO: 101 - protein, 175 aa, African swine fever virus; identical to SEQ ID NO: 43

SEQ ID NO: 102 - protein, 263 aa, African swine fever virus
MEDETELCFRSNKVTRLEMFVCTYGGKITSLACSHMELIKMLQIAEPVKALNCNFGHQCLPGYESLIKTPKKTKNMLRRPRKTEGDGTCFNSAIEASILFKDKMYKLKCFPSTGEIQVPGVIFPDFEDGKNIIQQWVDFLQHQPIEKKIQIIEFKTIMINFKFQINPVSPRVIIHLKKFAALLEHIPTPYPIREIKPPLEDSKVSAKFMVSPGKKVRINVFLKGKINILGCNTKESAEIIYTFLKDLISVHWQEILCVLPVPD

SEQ ID NO: 103 - protein, 263 aa, African swine fever virus
MEDETELCFRSNKVTRLEMFVCTYGGKITSLACSHMELIKMLQIAEPVKALNCNFGHQCLPGYESLIKTPKKTKNMLRRPRKTEGDGTCFNSAIEASILFKDKMYKLKCFPSTGEIQVPGVIFPDFEDGKNIIQQWVDFLQHQPIEKKIQIIEFKTIMINFKFQINPVSPRVIIHLKKFAALLEHIPTPYPIREIKPPLEDSKVSAKFMVSPGKKVRINVFLKGKINILGCNTKESAETIYTFLKDLISVHWQEILCVLPVPD

SEQ ID NO: 104 - protein, 407 aa, African swine fever virus
MEDTTFLEGANLAGITTLMNNLHINEQANLEELEKQVMGKQQSFPTDHFDEELNGLAKSLGINFNDPEFSLDSPHSVISKKPSGRGRDKVHGGIRRDSVCTDSICSDSVCSGSIRSGSIRSGSIRNGSIRSGSVRDDSVRSGKTRRGLACNSSSRNDRGYSLSTHRKKYAESEASQKTAFSKRDRKNHYAESEYSEKSIKPSTKQVDRLINHLRSNGDPNSFYKKDHDYERKTKLVKLEKINMLLTYLGNEQISTDDIKIPTIDSSMQEIDDVIEMLTLRNVGIRYSSIAEEILIGLARGLEIVFDGTREIPFLNYRPDYTGLHNTFMIKLFKMRYETSQVVGNLVQNMSPLSKICLELGPSLLLYPALIRTKHKASEDLYNLLQKGPEDPFTAYNEIHETLKKNNK

SEQ ID NO: 105 - protein, 412 aa, African swine fever virus
MEDTTFLEGANLAGITTLMNNLHINEQANLEELEKQVMGKQQSFPTDHFDEELNGLAKSLGINFNDPEFSLDSPHSIISKKPSGRGGDKVHGGIRRDSVCTDSICSDSVCSGSIRSGSIRSGSIRNGSIRSGSVRDGSIRNGSVRSGKTRRGLACNSSSRNDRGYSLSTHRKKYAESEASQKTAISKRDRKNHYAESEYSEKSIKPSTKQVDRLINHLRSNGDPNSFYKKDHDYERKTKLVKLEKINMLLTYLGNEQISTDDIKIPTIDSSMQEIDDVIEMLTLRNVGIRYSSIAEEILIGLARGLEIVFDGTREIPFLNYRPDYTGLHNTFMIKLFKMRYETSQVVGNLVQNMSPLSKICLELGPSLLLYPALIRTKHKASEDLYNLLQKGPEDPFTAYNEIHETLKKNNK

SEQ ID NO: 106 - protein, 438 aa, African swine fever virus
MYHDYASKLLADYRSDPPLWESDLPRHNRYSDNILNSRYCGNKNGAAPVYNEYTNSPEKAEKGLQLSDLRNFSFMLNPQHKNIGYGDAQDLEPYSSIPKNKLFNHFKNHRPAFSTHTENLIRRNVVRTEKKTFPQVASLKGTQKNCLTQPSSLPSLKNPKNSSVPSTRFSEHTKFFSYEDIPKLKTKGTIKHEQHLGDQMPGQHYNGYIPHKDVYNILCLAHNLPASVEKGIAGRGIPLGNPHVKPNIEQELIKSTSTYTGVPMLGPLPPKDSQHGREYQEFSANRHMLQVANILHSVFANHSIKPQILEDIPVLNAQLTSIKPVSPFLNKAYQTHYMENIVTLVPRFKSIANYSSPIPNYSKRNSGQAEYFDTSKQTISRHNNYIPKYTGGIGDSKLDSTFPKDFNASSVPLTSAEKDHSLRGDNSACCISSISPSL

SEQ ID NO: 107 - protein, 438 aa, African swine fever virus
MYHDYASKLLADYRSDPPLWESDLPRHNRYSDNILNSRYCGNKNGAAPVYNEYTNSPEKAEKGLQLSDLRNFSFMLNPQHKNIGYGDAQDLEPYSSIPKNKLFNHFKNHRPAFSTHTENLIRRNVVRTEKKTFPQVASLKGTQKNCLTQPSSLPSLKNPKNSSVPSTRFSEHTKFFSYEDLPKLRTKGTIKHEQHLGDQMPGQHYNGYIPHKDVYNILCLAHNLPASVEKGIAGRGIPLGNPHVKPNIEQELIKSTSTYTDVPMLGPLPPKDSQHGREYQEFSANRHMLQVSNILHSVFANHSIKPQILEDIPVLNAQLTSIKPVSPFLNKAYQTHYMENIVTLVPRFKSIANYSSPIPNYSKRNSGQAEYFDTSKQTISRHNNYIPKYTGGIGDSKLDSTFPKDFNASSVPLTSAEKDHSLRGDNSACCISSISPSL

SEQ ID NO: 108 - protein, 62 aa, African swine fever virus
MNWGSISSGTPGLFVESIRNTPSVVKINVIFLKVISNTAVSVFWRDRRIRFESDWLNSYFQK

SEQ ID NO: 109 - protein, 62 aa, African swine fever virus; identical to SEQ ID NO: 108

SEQ ID NO: 110 - protein, 129 aa, African swine fever virus
MDINPLLYLQAFNNDATTFNTQGHILEQQSDSPYFDTFANAMQAYLDTKQGGNDEEGTIILMDDEDFNDSESLEDFLQMLSEEELNDGFSSDDEPEEHVILTEDNQGEPSETPQATFDITEFIKIDDED

SEQ ID NO: 111 - protein, 129 aa, African swine fever virus
MDINPLLYLQAFNNDATTFNTQGHILEQQSDSAYFDTFANAMQAYLDTKQGGNDEEGTIILMDDEDFNDSESLEDFLQMLSEEELNDGFSSDDEPEEHVILTEDNQGEPSETPQATFDITEFIKTDDED

SEQ ID NO: 112 - protein, 250 aa, African swine fever virus
MDTAMQLKTSIGLITCRMNTQNNQIETILVQKRYSLAFSEFIHCHYSINANQGHLIKMFNNMTINERLLVKTLDFDRMWYHIWIETPVYELYHKKYQKFRKNWLLPDNGKKLISLINQAKGSGTLLWEIPKGKPKEDESDLTCAIREFEEETGITREYYQILPEFKKSMSYFDGKTEYKHIYFLAMLCKSLEEPNMNLSLQYENRIAEISKISWQNMEAVRFISKRQSFNLEPIIGPAFNFIKNYLRYKH

SEQ ID NO: 113 - protein, 250 aa, African swine fever virus
MDTAMQLKTSIGLITCRMNTQNNQIETILVQKRYSLAFSEFIHCHYSINANQGHLIKMFNNMTINERLLVKTLDFDRMWYHIWIETPVYELYHKKYQKFRKNWLLPDNGKKLISLINQAKGSGTLLWEIPKGKPKEDESDLTCAIREFEEETGITREYYQILPEFKKSMSYFDGKTEYKHIYFLAMLCKSLEEPNMNLSLQYENRIAEISKISWQNMEAVRFISKRQSLNLEPIIGPAFNFIKNYLRYKH

SEQ ID NO: 114 - protein, 345 aa, African swine fever virus
METFVRLFKDSPQQRSDAWHAIRRTQVGGSDLASVLGLNPYKSYYIILAEKANLFKKNLNRAACSWGTLFERVSKDLLELFCQTTVIGDNIHIDGTYLGYPGHSNSPDGFCHLTLGYTQQSWEIKTIFNNVRYEATKRIPVLVEIKSPFNRKIKNSVPSYYMPQIQSGLALSPPISMGIYVEAMFRVCGIHQLGSNNETNTDIHPPESMLPLAWGIITICSTQEHTEAPQDFGTLDAETFRQLLETLYQKDQYTIHYSMPYETACPEMPNVVGYFGWKVFIFQIIPVMKHPQFLKDKYPIIQQFLRDLHTIKASPSPMETYEKICCSEESALSTEDIDNFTDMLT

SEQ ID NO: 115 - protein, 345 aa, African swine fever virus
METFVRLFKDSPQQRSDAWHAIRRTQVGGSDLASVLGLNPYKSYYITLAEKANLFKKNLNRAACSWGTLFERVSKDLLELFCQTTVIGDNIHIDGTYLGYPGHSNSPDGFCHLTLGYTQQSWEIKTIFNNVRYEATKRIPVLVEIKSPFNRKIKNSVPSYYMPQIQSGLALSPPISMGIYVEAMFRVCGIHQLGSNNETNTDIHPPESMLPLAWGIITICSTQEHTEAPQDFGTLDAETFRQLLETLYQKDQYTIHYSMPYETACPEMPNVVGYFGWKVFIFQIIPVMKHPQFLKDKYPIIQQFLRDLHTIKASPSPMEMYEKICCSEESALSTEDIDNFTDMLT

SEQ ID NO: 116 - protein, 79 aa, African swine fever virus
MNKTIEYQKEFLKENNQLLSIPVKKNILKEILQNDEQDTIITNCITKEVSINLDLIKNPKVLYSIYIMVVEYLKSINIA

SEQ ID NO: 117 - protein, 79 aa, African swine fever virus; identical to SEQ ID NO: 116

SEQ ID NO: 118 - protein, 96 aa, African swine fever virus
MSTHDCFSKEKPVDMNDISEKSSVVDNAPEKPAGANHIPEKSAREMTSSEWIAEYWKGIKRGNDVPCCCPRKMTSADKKFSVFGKGSLIRSIQKNN

SEQ ID NO: 119 - protein, 96 aa, African swine fever virus
MSTHDCSLKEKPVDMNDISEKSVVVDNAPEKPAGANHIPEKSAREMTSSEWIAEYWKGIKRGNDVPCCCPRKMTSADKKFSVFGKGSLMRSIQKNN

SEQ ID NO: 120 - protein, 111 aa, African swine fever virus
MSFSECPLVISACKKFLQKRITIENEALINALITALAQTSTLNDLCLLPIQTYLLSYKNAFEWIHFVCIAITTILDNKYNWKDCTVDINYIFLHVTYIYNIKTKEYLDYCS

SEQ ID NO: 121 - protein, 111 aa, African swine fever virus; identical to SEQ ID NO: 120

SEQ ID NO: 122 - protein, 120 aa, African swine fever virus
MADFNSPIQYLKEDSRDRTSIGSLEYDENSDTIIPSFAAGLEDFEPIPSPTTSTSLYSQLTHNMEKIAEEEDINFLHDTREFTSLVPDEADNKPEDDEESGAKPKKKKHLFPKLSSHKSK

SEQ ID NO: 123 - protein, 122 aa, African swine fever virus
MADFNSPIQYLKEDSRDRTSIGSLEYDENADTMIPSFAAGLEEFEPIPDYDPTTSTSLYSQLTHNMEKIAEEEDSNFLHDTREFTSLVPDEADNKPEDDEESGAKPKKKKHLFPKLSSHKSK

SEQ ID NO: 124 - protein, 165 aa, African swine fever virus
MATNFFIQPITQEAEAYYPPSVITNKRKDLGVDVYCCSDLVLQPGLNIVRLHIKVACEHMGKKCGFKIMARSSMCTHERLLILANGIGLIDPGYVGELMLKIINLGDTPVQIWAKECLVQLVAQGDHVPDHINILKRNQIFPLFAPTPRGEGRFGSTGEAGIMRT

SEQ ID NO: 125 - protein, 165 aa, African swine fever virus
MATNFFIQPITEEAEAYYPPSVITNKRKDLGVDVYCCSDLVLQPGLNIVRLHIKVACEHMGKKCGFKIMARSSMCTHERLLILANGIGLIDPGYVGELMLKIINLGDTPVQIWAKECLVQLVAQGDHVPDHINILKRNQIFPLFAPTPRGEGRFGSTGEAGIMRT

SEQ ID NO: 126 - protein, 183 aa, African swine fever virus
MDSEFFQPVYPRHYGECLSPVTPPSFFSTHMYTILIAIVVLVIIIIVLIYLFSSRKKKAAAAIEEEDIQFINPYQDQQWAEVTPQPGTSKPAGATTASAGKPVTGRPATNRPATNKPVTDNPVTDRLVMATGGPAAAPAAASAHPTEPYTTVTTQNTASQTMSAIENLRQRNTYTHKDLENSL

SEQ ID NO: 127 - protein, 184 aa, African swine fever virus
MDSEFFQPVYPRHYGECLSPVTTPSFFSTHMYTILIAIVVLVIIIIVLIYLFSSRKKKAAAIEEEDIQFINPYQDQQWVEVTPQPGTSKPAGATTASVGKPVTGRPATNRPATNKPVTDNPVTDRLVMATGGPAAAPAAASAPAHPAEPYTTVTTQNTASQTMSAIENLRQRNTYTHKDLENSL

SEQ ID NO: 128 - protein, 184 aa, African swine fever virus
MKTFITCTSVKNYFRQHLKTNQRISSELISYVCTILNHICHQYLQNPQAQEEEWFALIKELPIIKDGLSKEERFFSSGVKHFLHEYKITPENQEKFQKMLNAITEQLMSRLCKVFSIMIQRQGFLKTQTLMYSHLFTILSILMVADNLYGEQDPTEFFSLIIEQTKTIKKKKKSSSEEEESHEE

SEQ ID NO: 129 - protein, 184 aa, African swine fever virus
MKTFITCTSVKNYFRQHLKTNQRISSELISYVCTILNHICHQYLQNPQAQEEEWFALIKELPIIKDGLSKEERFFSSGVKHFLHEYKITPENQEKFQKMLNAITEQLMSRLCKVFSIMIQRQGFLKTQTLMYSHLFTILSILMVADNLYGEQDPTEFFSLIIEQTKTIKKKKKSGSEEEESHEE

SEQ ID NO: 130 - protein, 199 aa, African swine fever virus
MSCMPVSTKCNDIWVDFSCTGPSISELQKKEPKAWAAILRSHTNQQTAEDDNIIGSICDKQGLCSKDEYAYSQYCACVNSGTLWAECAFAPCNGNKNAYKTTEQRNILTNKQCPSGLTICQNIAEYRGSGNISDLYQNFNCNSVINTFLINVMNHPFLTLILIILILIIIYRLMPSSGGKHNDDKLPPPSLIFSNLNNF

SEQ ID NO: 131 - protein, 199 aa, African swine fever virus
MSCMPVSTKCNDIWVDFSCTGPSISELQKKEPKAWAAILRSHTNQQTAEDDNIIGSICDKQGLCSKDEYAYSQYCACVNSGTLWAECAFAPCNGNKNAYKTTEQRNILTNKQCPSGLTICQNIAEYGGSGNISDLYQNFNCNSVINTFLINVMNHPFLTLILIILILIIIYRLMSSSGGKHNDDKLPPPSLIFSNLNNF

SEQ ID NO: 132 - protein, 248 aa, African swine fever virus
MGGSTSKNSFKNTTNIISNSIFNQMQNCISMLDGKNYIGVFGDGNILNHVFQDLNLSLDTSCVQKHVNEENFITNLSNQITQNLKDQEVALTQWMDAGHHDQKTDIEENIKVNLTTTLIQNCVSSLSGMNVLVVKGNGNIVENATQKQSQQIISNCLQGSKQAIDTTTGITNTVNQYSHYTSKNFFDFIADAISAVFKNIMVAAVVIVLIIVGFIAVFYFLHSRHRHEEEEEAEPLISNKVLKNAAVS

SEQ ID NO: 133 - protein, 248 aa, African swine fever virus
MGGSTSKNSFKNTTNIISNSIFNQMQSCISMLDGKNYIGVFGDGNILNHVFQDLNLSLNTSCVQKHVNEENFITNLSNQITQNLKDQEVALTQWMDAGTHDQKTDIEENIKVNLTTTLIQNCVSSLSGMNVLVVKGNGNIVENATQKQSQQIISNCLQGSKQAIDTTTGITNTVNQYSHYTSKNFFDFIADAISAVFKNIMVAAVVIVLIIVGFIAVFYFLHSRHRHEEEEEAEPLISNKVLKNAAVS

SEQ ID NO: 134 - protein, 296 aa, African swine fever virus
MFGAFVSHRLWSDSGCTTTCITNSIANYVAFGEQIGFPFKSAQVFIAGPRKAVINIQEDDKVELLKMIVKHNLWVVAHGTYLDVPWSRRSAFVTHFIQQELLICKEVGIKGLVLHLGVVEPELIVEGLKKIKPVEGVVIYLETPHNKHHTYKYSTMEQIKELFLRIRNTRLKQIGLCIDTAHIWSSGVNISSYNDAGQWLRSLENIHSVIPPSHIMFHLNDAATECGSGIDRHASLFEGMIWKSYSHKIKKSGLYCFVEYITRHQCPAILERNLGSSMQLQTALTAEFTTLKSLLK

SEQ ID NO: 135 - protein, 296 aa, African swine fever virus
MFGAFVSHRLWSDSGCTTTCITNSIANYVAFGEQIGFPFKSAQVFIAGPRKAVINIQEDDKVELLKMIVKHNLWVVAHGTYLDVPWSRKSAFVTHFIQQELLICKEVGIKGLVLHLGAVEPELIMEGLKKIKPVEGVVIYLETPHNKHHTYKYSTIEQIKELFLRIRNTRLKQIGLCIDTAHIWSSGVNISSYNDAGQWLRSLENIHSVIPPSHIMFHLNDAATECGSGIDRHASLFEGMIWKSYSHKIKQSGLYCFVEYVTRHQCPAILERNLGSSMQLQTALTAEFTTLKSLLK

SEQ ID NO: 136 - protein, 301 aa, African swine fever virus
MSEDIRRGPGRPPKKRVVPNFERKGILEKPVRPQSRLEFSYDNPLIFKNLFIYFKNLKSKNILVRCTPTEITFFSRDQSQASFVIATIDGKNVNHYYASDVFWLGINRELVEKMFNSIDRSFLKITIVHRYDKPETLFFIFTDFDIDKECTYQITVSEPELDMDLIEMEKSISEERLKNYPLRWEFTSKQLKKTFSDLSNYTELVTIEKLGGDTPLHLYFQKFNSISYHEMYKSSNKINLTSTIPKSQVFQINVKIAHIKSLASAMVTDKIRILCEENGNLIFQSEMDALMLNTITLNNTI

SEQ ID NO: 137 - protein, 301 aa, African swine fever virus
MSEDIRRGPGRPPKKRVVPNFERKGILEKPVRPQSRLEFSYDNPLIFKNLFIYFKNLKSKNILVRCTPTEITFFSRDQSQASFVIATIDGKNVNHYYASDVFWLGINRELVEKMFNSIDRSFLKITIVHRYDKPETLFFIFTDFDIDKECTYQITVSEPELDMDLIEMEKSISEERLKNYPLRWEFTSKQLKKTFSDLSNYTELVTIEKLGGDTPLHLYFQKFNSISYHEMYKSSNKINLTSTIPKSQVFQINVKIAHIKSLASAMVTDKIRILCEENGNLIFQSEMDALMLNTITLNTTI

SEQ ID NO: 138 - protein, 152 aa, African swine fever virus
MYSILIACLVLLLCLVIYVGHRADHARKYLEGMWHGDPVFLKQSGLQSFYLYIQPGHTCFFSIVNKNGEKLMETKIPCTITNKIYMFFKPIFEFHVVMEDIHRYLPKQFNFLLDSAEGKLILENNHVIYAVLYKDNFATALGKTVEKYITQN

SEQ ID NO: 139 - protein, 152 aa, African swine fever virus
MYSILIACLVLLLCLVIYVGHRADHARKYLEGMWHGDPVFLKQSGLQSFYLYIQPDHTCFFSIVNKNGEKLMETKIPCTITNKIYMFFKPIFEFHVVMEDIHSYFPKQFNFLLDSTEGKLILENNHVIYAVLYKDNFATALGKTVEKYITQN

SEQ ID NO: 140 - protein, 364 aa, African swine fever virus
MYFLVADHREHHVIPFLKTDFHDMQHNPMFTQKQALLEIKQLFTGDYLICKSPTTILACIERKTYKDFAASLKDGRYKNRQKMLSLREQTNCQLYFFVEGPAFPNPQKKINHVAYASIITAMTHLMVRDHIFVIQTKNEAHSSQKLVQLFYAFSKEMVCVVPTSLTPTDEELCIKLWSSLSGISGVIGKILANTCSVAHLVSGKLSSQNIDQLKTPSNRPFPKKVKRMLISISKGNKELEIKLLSGVPNIGKKLAAEILKDHALLFFLNQPVECLANIQIVQKTRTIKLGMKRAEAIHYFLNWCGSAHVTDDSQNITEASRPATQPAATQPLHEVSDDATSNASDTSSPIGHQTLSKEMLLNTA

SEQ ID NO: 141 - protein, 369 aa, African swine fever virus
MYFLVADHREHHVIPFLKTDFHHMHQNPIQKNQALLEIKQLFTGDYLICKSPSTILACIERKTYKDFAASLKDGRYKNRQKMLSLREQTNCQLYFFVEGPAFPNPQKKINHVAYASIITAMTHLMVRDHIFVIQTKNEAHSSQKLVQLFYAFSKEMVCVVPTSLTPTDEELCIKLWSSLSGISGVIGKILANTCSVAHLVHGKLSSQNIDQLKTPSNRPFPKKVKRMLISISKGNKELEIKLLSGVPNIGKKLAAEILKDHALLFFLNQPVECLANIQIVQKTRTIKLGMKRAEAIHYFLNWCGSAHVTDDSQNITEASRSTMQVATQSAAIQPAATQPLHEVSDDASSDASSPVGYQTLSKEMLLNTA

SEQ ID NO: 142 - protein, 165 aa, African swine fever virus
MANPNKRIMNKKSKQASISSILNFFFFYIMEYFVAVDNETPLGVFTSIEQCEETMKQYPGLHYVVFKYTCPADAENTDVVYLIPSLTLHTPMFVDHCPNRTKQARHVLKKINLVFEEESIENWKVSVNTVFPHVHNRLSAPKFSIDEANEAVEKFLIQAGRLMSL

SEQ ID NO: 143 - protein, 165 aa, African swine fever virus
MVNPNKRIMNKKSKQASISSILNFFFFYIMEYFVAVDNETSLGVFTSIEQCEETMKQYPGLHYVVFKYMCPADAENTDVVYLIPSLTLHTPMFVDHCPNRTKQARHVLKKINLVFEEESIENWKVSVNTVFPHVHNRLSAPKLSIDEANEAVEKFLIQAGRLMSL

SEQ ID NO: 144 - protein, 317 aa, African swine fever virus
MVETQMDKLGFLLNHIGKQVTTKVLSNAHITQTMKEIILENHGVDGGAAKNVSKGKSSPKEKKHWTEFESWEQLSKSKRSFKEYWAERNEIVNTLLLNWDNVRGAIKKFLDDDREWCGRINMINGVPEIVEIIPSPYRAGENIYFGSEAMMPADIYSRVANKPAMFVFHTHPNLGSCCGGMPSICDISTTLRYLLMGWTAGHLIISSNQVGMLTVDKRIIVDLWANENPRWLMAQKILDIFMMLTSRRSLVNPWTLRDLKKILQDYGIEYIIFPSNDFFIYEDERLLMFSKKWTNFFTLHELLDDLETIETKASSTT

SEQ ID NO: 145 - protein, 317 aa, African swine fever virus
MVETQMDKLGFLLNHIGKQVTTKVLSNAHITQTMKEIILENHSVDGGAAKNVSKGKSSPKEKKHWTEFESWEQLSKSKRSFKEYWAERNEIVNTLLLNWDNVRGAIKKFLDDDREWCGRINMINGVPEIVEIIPSPYRAGENIYFGSEAMMPADIYSRVANKPAMFVFHTHPNLGSCCGGMPSICDISTTLRYLLMGWTAGHLIISSNQVGMLTVDKRIIVDLWANENPRWLMAQKILDIFMMLTSRRSLVNPWTLRDLKKILQDYGIEYIIFPSNDFFIYEDERLLMFSKKWTNFFTLHELLDDLETIETKASSTT

SEQ ID NO: 146 - protein, 124 aa, African swine fever virus
MNLEYVQVVQKFNQVLLELTKKVCTVVGGSKPTYWYHHIRRVCSECPSMPMSMIGPYLNVYKAQILTRDKNFFMNFDPAHNEYTFIIQKLKEAARNMPEDELEQYWVKLLFLLKSYIKCKPFIN

SEQ ID NO: 147 - protein, 124 aa, African swine fever virus; identical to SEQ ID NO: 146

SEQ ID NO: 148 - protein, 171 aa, African swine fever virus
MVVYDLLVSLSKESIDVLRFVEANLAAFNQQYIFFNIQRKNSITTPLLITPQQEKISQIVEFLMDEYNKNNRRPSGPPREQPMHPLLPYQQSSDEQPMMPYQQPPGNDDQPYEQIYHKKHASQQVNTELNDYYQHILALGDEDKGMDSMLKLPEKAKRGSDDEDDMFSIKN

SEQ ID NO: 149 - protein, 171 aa, African swine fever virus
MVVYDLLVSLSKESIDVLRFVEANLAAFNQQYIFFNIQRKNSITTPLLITPQQEKISQIVEFLMDEYNKNNRRPSGPPREQPMHPLLPYQQSSDEQPMMPYQQPPGNDDQPYEQIYHKKHASQQVNTELNDYYQHILALGDEDKGMDSMLKLPEKAKRDSDDEDDMFSIKN

SEQ ID NO: 150 - protein, 359 aa, African swine fever virus
MEKIFQNVEIKPFLIDFSNPFIKNAAKRLFQLEEQLPLVPVNVVMDFKGISRAAVHGLSRVLQDEIPNYMLDIKPGGYKIEDSTDLFMTEQFIRNRINFIPIYAKNETLVFALRSLNNSCEVKTIYSRDLIQVAGPKLKYPIFNPTFEIGFLQPGKSLIIEDIYIKKGIGRKHAAFNLAVKTHFSHLDIEQYPTDKKEYMALSGYKQSSMTSDPRHHRLGLCFPAVPLPHINQAVRTYLKNACRIIIGRIQSIQKIYENFEEPQPELVLFSLDEEKTKAIITIKDETHTIGNLLKTCIYEMIPDISFVGYQCVPHKQEMVLTIIHKASQEDLITLLEKSIQNIIQTFQILEKNVDELIA

SEQ ID NO: 151 - protein, 359 aa, African swine fever virus
MEKIFQNVEIKPFLIDFSNLFIKNAAKKLFQLEEQLPLVPVNVVMDFKGISRAAVHGLSRVLQDEIPNYMLDIKPGGYKIEDSTDLFMTEQFIRNRINFIPIYAKNETLVFALRSLNNSCEVKTIYSRDLIQVAGPKLKYPIFNPTFEIGFLQPGKSLIIEDIYIKKGIGRKHAAFNLAVKTHFSHLDIEQYPTDKKEYMALSGYKQSSMTSDPRHHRLGLCFPAVPLPHINQAVRTYLKNACRIIIGRIQSIQKIYENFEEPQPELVLFSMDEEKTKAIITIKDETHTIGNLLKTYIYEMIPDISFVGYQCVPHKQEMVLTIIHKASQEDLITLLEKSIQNIIQTFQILEKNVDELIA

SEQ ID NO: 152 - protein, 177 aa, African swine fever virus
MYEIILAIIIILLTIIIFYFYKTPFKCITTTKTPVLFIKFQLIAADNYQAITWKNGVLSYEKIDQPTPLYLSVNGLIFDCAKLQPLTTNTNVISGDKDIHIGQTFEYNNLLMWKVNDQGFLNITVTGTKFNLIAITGKLGFYTDPPSHLMIMPLKIFPVHKFSKNEPNKKQKRFIYF

SEQ ID NO: 153 - protein, 66 aa, African swine fever virus
MWKVNDQGFLNISVTGTKFNLIAITGKLGFYTDPPSHLIIMPLKFFPVHKFSKNEPNKKQKRFIYF

SEQ ID NO: 154 - protein, 196 aa, African swine fever virus
MLFRYLVWLFRFIEVKNVVSISLLVIGSNYLTTAISNNTSTTISPTTSSNYLLTAISNNTSTTILPTTTSSNYLTSAIPNIISDKEDDTPFSTDKTVSDGLSPITLYRAIRSTLNDTMTDILTRPYRPTTVIFHSDTPQPVKNATQGNIIKKTYRQVLTFFIQPNPLFPCFKNHEVFLNLANILNTILCIILIKNV

SEQ ID NO: 155 - protein, 202 aa, African swine fever virus
MLFRYLVWLFRFIEVKNVVSISLLVIGSNYLTTAISNNTSTTISPTTTSSNYLMTAISNNTSTTISPTTTSSNYLMTAIPNIISDKEDDIHFSTDKTVFDRLSPITLYRAIRSTLNDTSTKTMTDHILTRPYRPTTVIFHSDTPQPVKNATQGNIVKKIYRQVLTFFIQPNPLFPCFKNHEVFLNLANILNTILCIILIKNV

SEQ ID NO: 156 - protein, 215 aa, African swine fever virus
MVSRFLIAEYRHLIENPSENFKISVNENNITEWDVILRGPPDTLYEGGLFKAKVAFPPEYPYAPPKLTFTSEMWHPNIYPDGRLCISILHGDNAEEQGMTWSPAQKIDTILLSVISLLNEPNPDSPANVDAAKSYRKYVYKEDLESYPMEVKKTVKKSLDECSPEDIEYFKNAASNVPPIPSDAYEDECEEMEDDTYILTYDDDEEEEDEEMDDE

SEQ ID NO: 157 - protein, 212 aa, African swine fever virus
MVSRFLIAEYRHLIENPSENFKISVNEKDMTEWDVILRGPPDTFYEGGLFKAKIAFPPEYPYAPPRLTFTSEMWHPNIYSDGKLCISILHGDNAEEQGMTWSPAQKIDTILLSVISLLNEPNPDSPANVDAAKSYRKLLYKEDLESYPMEVKRTVKKSLDECSPEDIEYFKNAASNVPPIPSDAYEDECEEMEDDTYILTYDDEDEEEEDDE

SEQ ID NO: 158 - protein, 267 aa, African swine fever virus
MLLVLIDVDGFMGQLYNENGTQTILIPREVVIFYWEKNTASKILQLFFHGGIDPIFEKINQRSFSFQSRHIHHFTLDESPLPNSIALPTDTLQAFKAGKKMIFQHLVKITKDHEQILLLHKGGPEGEWVRSFNIPNATVQNLNDLCCPSVEKLVLKKRDYISSSIGCPKHIQGSNHCPVFECHVLFKWIQENTSIVQGVLKRPSLPYEEAVLFIEHRINMVDNHPFKKDSVKQNQKKKNWIATQFVQHGIYVDNGILSKIYNKYSLF

SEQ ID NO: 159 - protein, 279 aa, African swine fever virus
MLLVLIDVDGFMGQLYNENGTQTILIPREVVIFYWEKNTPSKILQLFFHGGIDPIFEKINQRSFSFQSRHIHHFTLDESPLPNSIALPTDTLQAFKAGKKMIFQHLVKITKDHEQILLLHKGGPEGEWIRSFNIPNATVQNLNDLCCPSVEKLVLKKRDYISSSIGCPKHIQGSNHCPVFECHVLFKWIQENTSIVQGVLERPSLPYEKADLFIEHRINMVDNHPFKKDSIKQNQKKRTGSQRNLSNMGYMLTMASLARFIINTASFNKCIYPLSQDIR

SEQ ID NO: 160 - protein, 205 aa, African swine fever virus
MVEPREQFFQDLLSAVDQQMDTVKNDIKDIMKEKTSFMVSFENFIERYDTMEKNIQDLQNKYEEMAANLMTVMTDTKIQLGAIIAQLEILMINGTPLPAKKTTIKEAMPLPSSNTNNDQTSPPASGKTSETPKKNPTNAMFFTRSEWASSKTFREKFLTPEIQAILDEQFANKTGIERLHAEGLYMWRTQFSDEQKKMVKEMMKK

SEQ ID NO: 161 - protein, 205 aa, African swine fever virus
MVEPREQFFQDLLSAVDQQMDTVKNDIKDIMKEKTSFMVSFENFIERYDTMEKNIQDLQNKYEEMAANLMTVMTDTKIQLGAIIAQLEILMINGTPLPAKKTTIKEAMPLPSSNTNNEQTSPPASGKTSETPKKNPTNAMFFTRSEWASSNTFREKFLTPEIQAILDEQFANKTGIERLHAEGLYMWRTQFSDEQKKMVKEMMKK

SEQ ID NO: 162 - protein, 78 aa, African swine fever virus
MPTKAGTKSTANKKTTKGSSKSGSSRGHTGKTHASSSMHSGMLYKDMVNIARSRGIPIYQNGSRLTKSELEKKIKRPK

SEQ ID NO: 163 - protein, 78 aa, African swine fever virus
MPTKAGTKSTANKKTTKGSSKSGSSRGHTGKTHASSSMHSGMLYKDMVNIARSRGIPIYQNGSRLTKSELEKKIKRSK

SEQ ID NO: 164 - protein, 177 aa, African swine fever virus
MFNIKMTISTLLIALIILVIIILVVFLYYKKQQPPKKVCKVDKDCGSGEHCVRGTCSTLSCLDAVKMDKRNIKIDSKISSCEFTPNFYRFTDTAADEQQEFGKTRHPIKITPSPSESHSPQEVCEKYCSWGTDDCTGWEYVGDEKEGTCYVYNNPHHPVLKYGKDHIIALPRNHKHA

SEQ ID NO: 165 - protein, 189 aa, African swine fever virus
MRSSKKINNKKNMFNIKMTISTLLIALIILLIIILVVFLYYKKQQPPKKVCKVDKDCGSGEHCVRGSCSSLSCLDAVKMDKRNIKIDSKISSCEFTPNFYRFTDTAADEQQEFGKTRHPIKITPSPSESHSPQEVCEKYCSWGTDDCTGWEYVGDEKEGTCYVYNNPHHPVLKYGKDHIIALPRNHKHA

SEQ ID NO: 166 - protein, 174 aa, African swine fever virus
MLTLIQGKKIVNHLRSRLAFEYNGQLIKILSKNIVAVGSLRREEKMLNDVDLLIIVPEKKLLKHVLPNIRIKGLSFSVKVCGERKCVLFIEWEKKTYQLDLFTALAEEKPYAIFHFTGPVSYLIRIRAALKKKNYKLNQYGLFKNQTLVPLKITTEKELIKELGFTYRIPKKRL

SEQ ID NO: 167 - protein, 174 aa, African swine fever virus
MLTLIQGKKIVNDLRSRLAFEYNGQLIKILSKNIVAVGSLRREEKMLNDVDLLIIVPEKKLLKHVLPNIRIKDLSFSVKVCGERKCVLFIEWKKNTYQLDLFTALAEEKPYAVLHFTGPVSYLIRIRAALKKKNYKLNQYGLFKNQTLVPLKITTEKELIKELGFTYRIPKKRL

SEQ ID NO: 168 - protein, 183 aa, African swine fever virus
MSVVVGGVEYSLNNWARYEIKRRAAELESVNYYPHCEYIMPEDIVVSILGSKPNCPFLEALKRFHDFLKKRRIIFKGEYLVIPWMGAQDVADMIHHVENRINLDHLEDLAHMLKLITYHKSFDTCINQAFEHLYAFKFPDANIETHELKHIRQLEKKMYGYILRLEKLQTVLTFYIEFLLKQV

SEQ ID NO: 169 - protein, 183 aa, African swine fever virus
MSVVVGGVEYSLNNWARYEIKRRAAELESVNYYPHCEYIMPEDIVVSILGSKPNCPFLEALKRFHDFLKKRRIIFKGEYLVIPWMGAQDVADMIHHVENRINLDHLEDLAHMLKLITYHRSFDTCINQAFEHLYAFKFPDANIETHELKHIRQLEKKMYGYILRLEKLQTVLTFYIEFLLKQV

SEQ ID NO: 170 - protein, 208 aa, African swine fever virus
MSILEKITSSPSECAEHLTNKDSCLSKKIQKELTSFLEKKETLGCDSESCVITHPAVKAYAQQKGLDLSKELETRFKAPGPRNNTGLLTNFNIDETLQRWAIKYTKFFNCPFSMMDFERVHYKFNQVDMVKVYKGEELQYVEGKVVKRPCNTFGCVLNTDFSTGTGKHWVAIFVDMRGDCWSIEYFNSAGNSPQVPLFAGWNGSNSSY

SEQ ID NO: 171 - protein, 273 aa, African swine fever virus
MSILEKITSSPSECAEHLTNKDSCLSKKIQKELTSFLEKKETLGCDSESCVITHPAVKAYAQQKGLDLSKELETRFKAPGPRNNTGLLTNFNIDETLQRWAIKYTKFFNCPFSMMDFERVHYKFNQVDMVKVYKGEELQYVEGKVVKRPCNTFGCVLNTDFSTGTGKHWVAIFVDMRGDCWSIEYFNSTGNSPPGPVIRWMERVKQQLLKIHHTVKTLAVTNIRHQRSQTECGPYSLFYIRARLDNVSYAHFISARITDEDMYKFRTHLFRIA

SEQ ID NO: 172 - protein, 69 aa, African swine fever virus
MLLYIVIIVACIISKLVPNEYWAIHLFFIIMIFMVYMYEKLDIHQKYQFWNYTMSGLSGHNVQVICKCY

SEQ ID NO: 173 - protein, 69 aa, African swine fever virus
MLLYIVIIVACIISKLVPNEYWAIHLFFIIMIFMVYMYEKLDIHQKSQFWNYTMSGLSGHNVQVTCKCY

SEQ ID NO: 174 - protein, 10 aa, African swine fever virus
VPYDNISKLY

SEQ ID NO: 175 - protein, 9 aa, African swine fever virus
YAKPDAIML

SEQ ID NO: 176 - protein, 129 aa, African swine fever virus
MEHPSTNYTPEQQHEKLKYYVLIPKHLWSYIKYGTHVRYYTTQNVFRVGGFVLQNPYEAVIKNEVKTAIRLQNSFNTKAKGHVTWAVPYDNISKLYAKPDAIMLTIQENVEKALHALNQNVLTLASKIR

SEQ ID NO: 177 - protein, 129 aa, African swine fever virus
MEHPSTNYTPEQQHEKLKHYVLIPKHLWSYIKYGTHVRYYTTQNVFRVGGFVLQNPYEAVIKNEVKTAIRLQNSFNTKAKGHVTWAVPYDNISKLYAKPDAIMLTIQENVEKALHALNQNVLTLASKIR

SEQ ID NO: 178 - protein, 9 aa, African swine fever virus
IMDDLVEEY

SEQ ID NO: 179 - protein, 147 aa, African swine fever virus
MADNDNEDLIMDDLVEEYVETEEENLVDSEEESEDKDEIVESPSICEGFVQASSQTLVIIPDNERITSNVLTTFEATRLVAVRAQQLAINGSTMLKKKYSSPIDIAKQELFNRKIPLLVMRCIKVTPEGQKIVEIWNPREMGIPLLD

SEQ ID NO: 180 - protein, 9 aa, African swine fever virus
NKYLERQDL

SEQ ID NO: 181 - protein, 257 aa, African swine fever virus
MYSVCDVVRDAVAQSHLCACPNDKLPQCKGVTKAPPKCSVFHVAKLQDTKFKWKYTLDPLKAQKLSQIDKDIEKDAITLKLIYGIELSPEDLEWWKMQRCLINKKTGAKGGQFANKYLERQDLELLGYSPTPIIGGDFMFTALPDKVLRTIPVAWDRFLNPAMMIFFLIILLCVILGIFYVLVRNTLRRKQKSKQHQMEIKRFIKEKEQDPYIHTSFESWPADPNKEWKDLIPMYEAQGYCMADYRKKLGMPPGPNC

SEQ ID NO: 182 - protein, 257 aa, African swine fever virus
MYSVCDVVRDAVAQSHLCACPNDKLPQCKGVTKAPPKCSVFHVAKLQDTKFKWKYTLDPLKAQKLSQIDKDIEKDAITLKLIYGIELSPEDLEWWKMQRCLINKKTGAKGGQFANKYLERQDLELLGYSPTPIIGGDFMFTALPDKVLRTIPVAWDRFLNPAMMIFFLIILLCVILGIFYVLVRNTLRRKQKSKQHQMEIKRFIKEKEQDPYIHTSFESWPADPNKEWKDLIPVYEAQGYCMADYRKKLGMPPGPNC

SEQ ID NO: 183 - protein, 9 aa, African swine fever virus
KKISNYQLL

SEQ ID NO: 184 - protein, 11 aa, African swine fever virus
TMYNVLRRAYY

SEQ ID NO: 185 - protein, 10 aa, African swine fever virus
KMYEDYYSHF

SEQ ID NO: 186 - protein, 315 aa, African swine fever virus
MDALLKEIEKLSQPSLQKENNDVCDLCFMQMKKISNYQLLCEECGQLKDWFEPEYNEKFTVYSRLKIVGANSSYHQRDLDKANSSDYSSLQFHHILEELKSLNVKYMDAGQKPFPIQVLKETAHSYNQVQQHRVIRSITKLQILASILRSICLKLNIACTVADAARFTQLNTKGISRGMDLLRSLFVDNKITLNVDLNPIDSFINSTYSALQIKQIHQELQEENVYNLKEIVKSFILYADEKNIGVDLNRRTVVIATMYNVLRRAYYPIEIDTVVYQCKIRKNTITRALKMYEDYYSHFKSLYEQYHLNAAKKLI

SEQ ID NO: 187 - protein, 315 aa, African swine fever virus; identical to SEQ ID NO: 186

SEQ ID NO: 188 - protein, 9 aa, African swine fever virus
HKNDKNITL

SEQ ID NO: 189 - protein, 11 aa, African swine fever virus
LPDVSTLPYNY

SEQ ID NO: 190 - protein, 9 aa, African swine fever virus
SPNHVEDAY

SEQ ID NO: 191 - protein, 11 aa, African swine fever virus
TPADKSLFLFY

SEQ ID NO: 192 - protein, 9 aa, African swine fever virus
FVWVADLSY

SEQ ID NO: 193 - protein, 11 aa, African swine fever virus
NIFNTIPTLTY

SEQ ID NO: 194 - protein, 8 aa, African swine fever virus
NTIPTLTY

SEQ ID NO: 195 - protein, 11 aa, African swine fever virus
KQVAIHGFAAY

SEQ ID NO: 196 - protein, 15 aa, African swine fever virus
KQVAIHGFAAYALLY

SEQ ID NO: 197 - protein, 8 aa, African swine fever virus
AIHGFAAY

SEQ ID NO: 198 - protein, 9 aa, African swine fever virus
GFAAYALLY

SEQ ID NO: 199 - protein, 8 aa, African swine fever virus
STLPYNYY

SEQ ID NO: 200 - protein, 475 aa, African swine fever virus
MSSLLKTDFNVSKYRLIAQKREANAVEIEAALEVVREFIIKKKLILYGGIAIDYALHLKGSSIYPEGERPDFDMFSPNHVEDAYELADILYEKGFKQVGTVRAIHVQTMRVRTDFVWVADLSYMPPNIFNTIPTLTYKNLKIIHPDYQRAGLHLAFCFPFDNPPREDVFSRFKKDLQRYNLIEKYYPIPVVPVKSIYESKTFSIPFKQVAIHGFAAYALLYQTLNELRITCKVPEWKTEFPQPSYSYHKNDKNITLTVDMPKAYPALVLATYNPEEVIKEMGLHLTEICEPYMDYSPPIFKTNDIHFFSTMFKELAISIIQDNLIVVSPQYLLLYFLYGAFATPADKSLFLFYYNATLWILEKADSLLNIIQKQTSPEEFTRFANTSPFVLTTRVLSCSQERCTFSPAYRISLANDVQQSQLPLPKTHFLSNSLPDVSTLPYNYYPGKGKDRPTNFSYEKNLLFNIGGKCTPSAM

SEQ ID NO: 201 - protein, 475 aa, African swine fever virus
MTSLLKTDFNVSKYRLIAQKREANAVEIEAALEVVREFIIKKKLILYGGIAIDYALHLKGSSIYPEGERPDFDMFSPNHVEDAYELADILYEKGFKQVGTVRAIHVQTMRVRTDFVWVADLSYMPPNIFNTIPTLTYKNLKIIHPDYQRAGLHLAFCFPFDNPPREDVFSRFKKDLQRYNLIEKYYPIPVVPVKSTYESKTFSIPFKQVAIHGFAAYALLYQTLNELRITCKVPEWKTEFPQPSYSYHKNDKNITLTVDMPKAYPALVLATYNPEEVIKEMGLHLTEICEPYMDYSPPIFKTNDIHFFSTMFKELAISIIQDNLIVVSPQYLLLYFLYGAFATPADKSLFLFYYNATLWILEKADSLLNIIQKQTSPEEFTRFANTSPFVLTTRVLSCSQERCTFSPAYRISLANDVQQSQLPLPKTHFLSNSLPDVSTLPYNYYPGKGKDRPTNFSYEKNLLFNIGGKCTPSAM

SEQ ID NO: 202 - protein, 19 aa, African swine fever virus
KVISNTAVSVFWRDRRIRF

SEQ ID NO: 203 - protein, 11 aa, African swine fever virus
SVFWRDRRIRF

SEQ ID NO: 204 - protein, 62 aa, African swine fever virus; identical to SEQ ID NO: 108

SEQ ID NO: 205 - protein, 62 aa, African swine fever virus; identical to SEQ ID NO: 108

SEQ ID NO: 206 - protein, 13 aa, African swine fever virus
GEYRYRFVWYQPF

SEQ ID NO: 207 - protein, 8 aa, African swine fever virus
AIMITTEY

SEQ ID NO: 208 - protein, 11 aa, African swine fever virus
AIMITTEYVGY

SEQ ID NO: 209 - protein, 20 aa, African swine fever virus
ILMDEDSFMSLLFDLCYGAY

SEQ ID NO: 210 - protein, 11 aa, African swine fever virus
SFMSLLFDLCY

SEQ ID NO: 211 - protein, 11 aa, African swine fever virus
MTYYHFNPTSF

SEQ ID NO: 212 - protein, 16 aa, African swine fever virus
AFDILKYGYPMQQSGY

SEQ ID NO: 213 - protein, 11 aa, African swine fever virus
RQYGLAFVNTF

SEQ ID NO: 214 - protein, 11 aa, African swine fever virus
FFNSITAIDFY

SEQ ID NO: 215 - protein, 21 aa, African swine fever virus
FFNSITAIDFYAIARNLRSML

SEQ ID NO: 216 - protein, 8 aa, African swine fever virus
SITAIDFY

SEQ ID NO: 217 - protein, 717 aa, African swine fever virus
MTKLAQWMFEQYVKDLNLKNRGSPSFRKWLTLQPSLLRYSGVMRANAFDILKYGYPMQQSGYTVATLEIHFKNIRSSFANIYWNRDSEEPEYVCCCATYQSHDGEYRYRFVWYQPFIEAYNAIEAALDPLETIILNLIAARDLDFVVHIFPYNKGHEDYLASTQLILKIFIATLLMDILRIKDNTLDVHLNSDYIIVMERLWPHIKDAIEHFFEAHKDLLGYLIAFRNGGNFAGSLRPSCGQKIVPLTIREVLQMNDINLAVWREVFIMQECSDLVINGIAPCFPIFNTWTYLQGINQIFFENTSLQEKFKKDFIARELSKEIIKGQKTLNDKEFKKLSLHQIQYMESFLLMSDVAIMITTEYVGYTLQSLPGIISRSSYLSPIVKNILMDEDSFMSLLFDLCYGAYVLHKKENVIHADLHLNNMTYYHFNPTSFTDRNKPGKYTLKVKNPVIAFITGPKVETETYVFKHIDGFGCIIDFSRAIMGPNHAIKLERQYGLAFVNTFYRNQSEHILKVLRYYFPEMLTNRENEIQGVILSNFNFFFNSITAIDFYAIARNLRSMLSLDYLHTSEVKRNVEISQTFLDTCQFLEEKAVEFLFKNLHTVLSGKPVEKTAGDVLLPIVFKKFLYPNIPKNILRSFTVIDVYNYNNIKRYSGKAIQTFPPWAQTKEILTHAEGRTFEDIFPRGELVFKKAYAENNHLDKILQRIREQLANENL

SEQ ID NO: 218 - protein, 8 aa, African swine fever virus
MMMFITVY

SEQ ID NO: 219 - protein, 79 aa, African swine fever virus
MDQEQLFDKLYSLNLQLTAKNDQKKENRFFIRSGKKIQRIQMMMFITVYDINQKQKKRYGLRGCNLNLKATVLPLHKRI

SEQ ID NO: 220 - protein, 9 aa, African swine fever virus
ALANTSANY

SEQ ID NO: 221 - protein, 10 aa, African swine fever virus
YFSILAEYVY

SEQ ID NO: 222 - protein, 20 aa, African swine fever virus
YFSILAEYVYSYNGMLEHYM

SEQ ID NO: 223 - protein, 10 aa, African swine fever virus
SILAEYVYSY

SEQ ID NO: 224 - protein, 10 aa, African swine fever virus
YSYNGMLEHY

SEQ ID NO: 225 - protein, 9 aa, African swine fever virus
RQRSFIQTL

SEQ ID NO: 226 - protein, 17 aa, African swine fever virus
FQMTATMVAASNYNFII

SEQ ID NO: 227 - protein, 9 aa, African swine fever virus
ATMVAASNY

SEQ ID NO: 228 - protein, 962 aa, African swine fever virus
MREESWEDHDTIQLTAQRKYLAEVQALETLLTRELSVFLTEPGSKKTNIINRITGKTYALPSTELLRLYEHLEQCRKQGALMYFLERQGTYSGLMLDYDLKLNTNAVPPLEPPALSRLCHRIFVHIKNSSVLPEGSHKIHFFFTLKPEVVQGKYGFHVLIPGLKLAASTKKSIIGSLQHDATVQKILHEQGVTNPESCLDPHSASVPSLLYGSSKLNHKPYQLKTGFELVFDSSDPDYIPIHQIKNLESYNLVSELSLTNEQGSLVRPVYCAADIAAEKEEEIPTEDHSLSILMLHDPEARYLHKILNLLPPEYYVEYPLWSNVVFALANTSANYRPLAEWFSQKCPEKWNTGGKEKLEKLWNDASHHTEKKITKRSIMYWAHKHAPQQYKEIVEQGYFSILAEYVYSYNGMLEHYMIAKVIYAMMGNKFVVDVDSNGKYVWFEFVLPGQPMNQGEIWKWRKEVNPDELHIYISENFSRVMDRITEHIKYHLSQPHESNILNYYKKLLKAFERSKSKIFNDSFKKGVIRQAEFLFRQRSFIQTLDTNPHLLGVGNGVLSIETIPAKLINHFHEHPIHQYTHICYVPFNPENPWTKLLLNALQDIIPELDARLWIMFYLSTAIFRGLKEALMLLWLGGGCNGKTFLMRLVAMVLGDHYASKLNISLLTSCRETAEKPNSAFMRLKGRGYGYFEETNKSEVLNTSRLKEMVNPGDVTARELNQKQESFQMTATMVAASNYNFIIDTTDHGTWRRLRHYRSKVKFCHNPDPSNPYEKKEDPRFIHEYIMDPDCQNAFFSILVYFWEKLQKEYNGQIKKVFCPTIESETEAYRKSQDTLHRFITERVVESPSAETVYNLSEVVTAYAEWYNTNINVKRHIALELSQELENSVLEKYLQWSPNKTRILKGCRILHKFETLQPGESYIGVSTAGTLLNTPICEPKNKWWEWSPNPSAPPEKEASAPTP

SEQ ID NO: 229 - protein, 9 aa, African swine fever virus
AKSLFKEFL

SEQ ID NO: 230 - protein, 9 aa, African swine fever virus
WANEAEHLI

SEQ ID NO: 231 - protein, 123 aa, African swine fever virus
MPSTGTLVIIFAIVLILCIMLLFFYKTVEAEKPGVLPPPIPPPTPPPSKKKYDHNEYMEKTDLEPEVKKNHRKWANEAEHLISSSVKGLENLDETAFLANHKGHGFRTFEHAKSLFKEFLKKY

SEQ ID NO: 232 - protein, 122 aa, African swine fever virus
MPSTGTLVIIFAIVLILCIMLLFFYKTVEAGKSGVLPPPIPPPTPPPKKKYDHNEYMEKTDLEPEVKKNHRKWANEAEHLISSSVKGLENLDETAFLANHKGHGFRTFDHAKSLFKEFLKKY

SEQ ID NO: 233 - protein, 11 aa, African swine fever virus
SQVVFHAGSLY

SEQ ID NO: 234 - protein, 201 aa, African swine fever virus
MDFILNISMKMEVIFKTDLRSSSQVVFHAGSLYNWFSVEIINSGRIVTTAIKTLLSTVKYDIVKSARIYAGQGYTEHQAQEEWNMILHVLFEEETESSASSENIHEKNDNETNECTSSFETLFEQEPSSEVPKDSKLYMLAQKTVQHIEQYGKAPDFNKVIRAHNFIQTIYGTPLKEEEKEVVRLMVIKLLKKISFYLTYI

SEQ ID NO: 235 - protein, 9 aa, African swine fever virus
DNAPAGHYY

SEQ ID NO: 236 - protein, 9 aa, African swine fever virus
EFYQKLFSF

SEQ ID NO: 237 - protein, 9 aa, African swine fever virus
HNKQEFQSY

SEQ ID NO: 238 - protein, 9 aa, African swine fever virus
IPIYLKENY

SEQ ID NO: 239 - protein, 9 aa, African swine fever virus
ITKTFVNNI

SEQ ID NO: 240 - protein, 9 aa, African swine fever virus
NKALQKVGL

SEQ ID NO: 241 - protein, 10 aa, African swine fever virus
TPEEAAQRVY

SEQ ID NO: 242 - protein, 9 aa, African swine fever virus
VNDALSTRW

SEQ ID NO: 243 - protein, 9 aa, African swine fever virus
YINQALHEL

SEQ ID NO: 244 - protein, 23 aa, African swine fever virus
IQNNRSMMMVFNQLIASYITRFY

SEQ ID NO: 245 - protein, 11 aa, African swine fever virus
MMVFNQLIASY

SEQ ID NO: 246 - protein, 13 aa, African swine fever virus
YMSRYNKEPLMPF

SEQ ID NO: 247 - protein, 10 aa, African swine fever virus
YTHAIQALRF

SEQ ID NO: 248 - protein, 11 aa, African swine fever virus
YSFEEIACLMY

SEQ ID NO: 249 - protein, 8 aa, African swine fever virus
VTMIEAVY

SEQ ID NO: 250 - protein, 9 aa, African swine fever virus
AIQNWVQQY

SEQ ID NO: 251 - protein, 22 aa, African swine fever virus
SQVDLNQAINTFMYYYYVAQIY

SEQ ID NO: 252 - protein, 9 aa, African swine fever virus
NQAINTFMY

SEQ ID NO: 253 - protein, 11 aa, African swine fever virus
QAINTFMYYYY

SEQ ID NO: 254 - protein, 11 aa, African swine fever virus
FMYYYYVAQIY

SEQ ID NO: 255 - protein, 10 aa, African swine fever virus
VIYQHFNLEY

SEQ ID NO: 256 - protein, 2475 aa, African swine fever virus
MGNRGSSTSSRPPLSSEANLYAKLQDHIQRQTRPFSGGGYFNGGGDKNPVQHIKDYHIDSVSSKAKLRVIEGIIRAIAKIGFKVDTKQPIEDILKDIKKQLPDPRAGSTFVKNAEKQETVCKMIADAINQEFIDLGQDKLIDTTDGAASICRQIVLYINSLTHGLRAEYLDVHGSIENTLENIKLLNDAIKQLHERMVTEVTKAAPNEEVINAVTMIEAVYRRLLNEQNLQINILTNFIDNILTPTQKELDKLQTDEVDIIKLLNDTNSVLGTKNFGKVLSYTLCNLGIAASVANKINKALQKVGLKVEQYLQSKNWAEFDKELDLKRFSGLVSAENIAEFEKAVNLLRQTFNERHKILENSCAKKGGDEEKTPLDRRIEAQRLDRKHILMEFLNKSTQAYNDFLENVKKIGIKLVKEIALTPNITRLRDALSRINDMGTIALDLSLIGFYTNAAAREERETFLTQFMLVKNVLEEQSKIDPNFKNLYDSCSRLLQIIDFYTDIVQKKYGGGEDCECTRVGGAALTVEELGLSKAARSQVDLNQAINTFMYYYYVAQIYSNLTHNKQEFQSYEENYATILGDAIAGRLMQLDTEKNARINSPAVDLARGHVGPNPGGAQEADWKAAVSAIELEYDVKRRFYRALEGLDLYLKNITKTFVNNIDSIQTVQQMLDGVRIIGRWFTEATGDTLAQVFESFPTSAGNDSNVFTDNAPAGHYYEKVAAEIQQGRSVGTLRPVRASQAKNIRDLIGRSLSNFQALKNIINAFARIGDMLGGEELRQMVPMSPLQIYKTLLEYIQHSALSVGLKNLNQSEIGGQRVALARTPEEAAQRVYLSTVRVNDALSTRWETEDVFFTFMLKSMAAKIFIVLGIYDMFERPEPVYKLIPTRMILGGADELEPEVIPEAAELYFRLPRLAEFYQKLFSFRDENVQISMLPELEGIFSGLIRIIFMRPIELINIGDYSETEIRQLIKEINVIYQHFNLEYGEQEATKKALIHFVNEINRRFGVITRTEWEKFQRIVQEARTMNDFGMMNQTNYSILPDEDGYTQSSQLLPSDRFISPSTQPTPKWRPALYNIDSVDVQTGMLQPNSQWDLVQKFRKQLSEMFEDPSLQQELGKVSYQELIRQAINELKKEHTDKIQIVSKLIQGSESLADTDVNKIFLFHETVITGLNLLSAIYVLLNNFRNNIKGLDLDTIQKSIIEWLRETQAANVNRANLIDWLGRKHGAISEIRNPGLVVKENDVRLSRVYPDPTTNATAPQDQNLVTETLFAWIVPYVGIPAGGGVRAEQELAARYLVDNQRIMQLLLTNIFEMTSSFNKMVQVRFPETSTAQVHLDFTGLISLIDSLMADTKYFLNLLRPHIDKNIIQYYENRSNPGSFYWLEEHLIDKLIKPPTDAGGRPLPGGELGLEGVNQIINKTYILLTKPYNVLQLRGGVQRRDAANIQINNNPQPSERFEQYGRVFSRLVFYDALENNSGLRVEQVVLGDFRLSNLIRTNNAQEENTLSYWDNMAPRTYANVNDAANNLRRYRLYGSDYGIQNNRSMMMVFNQLVASYIARFYDAPSGKIYLNLINAFANGNFSQAVMELGYTHPDLARDNIAFGHRGDPTEQSVLLLSLGLMLQRLIKDTNRQGLSQHLISTLTEIPIYLKENYRANLPLFNKMFNILISQGELLKQFIQYTNVQLARPNLMGLLGANNDSVIYYNNNINVPMTGLSVGQAALRGIGGVFRPNVTLMPLGDAQNNTSDVVRKRLVAVIDGIIRGSHTLADSAMEVLHELTDHPIYLETEEHFIQNYMSRYNKEPLMPFSLSLYYLRDLRIENNEVYDPLLYPNLESGSPEFKLLYGTRKLLGNDPVQLSDMPGVQLIMKNYNETVVAREQITPTRFEHFYTHAIQALRFIVNIRSFKTVMMYNENTFGGVNLISENRDDKPIITAGIGMNAVYSLRKTLQDVISFVESSYQEEQINHIHKIVSPKGQTRTLGSNRERERIFNLFDMNIIPINVNALMRSIPLANIYNYDYSFEEIACLMYGISAEKVRSLNTAAPQPDIAEVLNIPNRPPMNTREFMLKLLINPYVSVSITQYGNELMSKGSAGYMSRIFRGDNALNMGRPKFLSDQIFNKVLFGSLYPTQFDYDEAGPGLAAGIQRGREQWGQPLSEYINQALHELVRTIRIPQKLRVLRNIIVKNQLIADLTTIREQLVSMRREVENMIQTPEIQNNPTPEVIAAAQNWTQQYRARVDTLINFIGNIGQPNSMLDLIQTITPVTVRAQLGVIFNRHGIPVPHPRQILQTDDEATQWFMTNILNIPAIIMTPFTDLANDLRTFLETLERYVFNVPRWLGPSTGRVARAPVRMAPRDMRHPISYTENSVLTYITEQNREEGPWSIVKQVGVGIQKPTLVQIGKDRFDTRLIRNLIFITNIQRLLRLRLNLELSQFRNVLVSPDHIINPSITEYGFSITGPSETFSDKQYDSDIRIL

SEQ ID NO: 257 - protein, 2476 aa, African swine fever virus
MGNRGSSTSSRPLPSSEANIYAKLQDHIQRQTRPFSGGGYFNGGGDKNPVQHIKDYHIDSVSSKAKLRIIEGIIRAIAKIGFKVDTKQPIEDILKDIKKQLPDPRAGSTFVKNAEKQETVCKMIADAINQEFIDLGQDKLIDTTEGAASICRQIVLYINSLTHGLRAEYLDVHGSIENTLENIKLLNDAIKQLHERMVTEVTKAAPNEEVINAVTMIEAVYRRLLNEQNLQINILTNFIDNILTPTQKELDKLQTDEVDIIKLLNDTNSVLGTKNFGKVLSYTLCNLGIAASVANKINKALQKVGLKVEQYLQSKNWAEFDKELDLKRFSGLVSAENIAEFEKAVNLLRQTFNERHKILENSCAKKGGDEEKTPLDRRIEAQRLDRKHILMEFLNKSTQAYNDFLENVKKIGIKLVKEIALTPNITRLRDALSRINDMGTIALDLSLIGFYTNAAAREERETFLTQLTLVKNVLEEISKTDPNFKNLYDSCSRLLQIIDFYTDIVQKKYGGEEDCECTRVGGAALTVEELGLSKAARSQVDLNQAINTFMYYYYVAQIYSNLTHNKQEFQSYEENYATILGDAIAGRLMQLDTEKNARINSPAVDLARGHVGPNPGGAQEVDWKATVSAIELEYDVKRRFYRALEGLDLYLKNITKTFVNNIDSIQTVQQMLDGVRIIGRWFTETTGDTLAQVFESFPTSTGNDSNVFTDNAPAGHYYEKVAAEIQQGRSVGTLRPVRASQAKNIRDLIGRSLSNFQALKNIINAFARIGDMLGGEELRQMVPMSPLQIYKTLLEYLQHSALSVGLKNLNQSEIGGQRMALAQTAEEAAQRVYLSTVRVNDALSTRWETEDVFFTFMLKSMAAKIFIVLGIYDMFERPEPVYKLIPTRMILGGADELEPEVIPEAAELYFRLPRLAEFYQKLFSFRDENVQISMLPELEGIFSGLIRIIFMRPIELINIGDYSETEIRQLIKEINVIYQHFNLEYGEQEATKKALIHFVNEINRRFGVITRTEWEKFQRIVQEARTMNDFGMMNQTNYSILPDEDGYTQSSQLLPSDRFISPSTQPTPKWRPALYNIDSVDVQTGMLQPNSQWDLVQKFRKQLSEMFEDPSLQQELGKISYQELIRQAINELKKEHTDKIQIVSKLIQGSESLADTDVNKIFLFHETVITGLNLLSAIYVLLNNFRNNIKGLDLDTIQKSIIEWLRETQAANVNRANLIDWLGRKHGAISEIRNPGLVIKEINMRLSMVYPDPTTEAAAAAQDRNLTTETLFAWIVPYVGIPAGGGVRPEQELAARYLVDNQRIMQLLLTNIFEMTSSFNKMVQVRFPETSTAQVHLDFTGLISLIDSLMADTKYFLDLLRPHIDKNIIQYYENRSNPGSFYWLEEHLIDKLIKPPTDAGGRPLPGGELGLEGVNQIINKTYTLLTKPYNVLQLRGGAQRRDAANIQINNNPQSSERFEQYGRVFSRLVFYDALENNSGLRVEQVALGDFRLSNLIRTNNAQEENTLSYWDNIALRTYANVNDAANNLRRYRLYGSDYGIQNNRSMMMVFNQLIASYITRFYDAPSGKIYLNLINAFANGNFSQAVMEMGYAHPDLARNNNVFGHRGDPTEQSVLLLSLGLILQRLIKDTNRQGLSQHLISTLTEIPIYLKENYRANLPLFNKMFNILISQGELLKQFIQYTNVQLARPNLTALLGANNDSVIYYNNNNVPATGLSVGQAALRGIGGVFRPNVTLMPLGDAQNNTSDVVRKRLVAVIDGIIRGSHTLADSAMEVLHELTDHPIYLETEEHFIQNYMSRYNKEPLMPFSLSLYYLHDLRIENNEVYDPLLYPNLESGSPEFKLLYGTRKLLGNDPVQLSDMPGVQLIMKNYNETVVAREQITPTRFEHFYTHAIQALRFIINIRSFKTVMMYNENTFGGVNLISENRDDKPIITAGIGMNAVYSLRKTLQDVISFVESSYQEEQINHIHKIVSPKGQTRTLGSNRERERIFNLFDMNIIPINVNALMRSIPLANIYNYDYSFEEIACLMYGISAEKVRSLDTTAPQPDVAEVLNIPNRPPINTREFMLKLLINPYVSVSITQYGNELLSKGNAGYMSRIFRGDNALNMGRPKFLSDQIFNKVLFGSLYPTQFDYDEAGPSLAAGIQRGRERWGHPMSIYINQALHEIVRTIRLAETVRGLRNVIDRNQIIGELNAFRTQLEDTRREVNNLIQTPEIQNNPTPEIIAAIQNWVQQYRGQITNLIDLIGNAGQANSMINLIQNITPQTAGAQLTALFNIRGLPAPPPRQALQNDIEAMQWFMTMVINHPPVLIAPFMLLVNNLKEFLNTLERYVYKTPRWLGPGTARIAQPPVGMAPGINMRHHTSYTENSVLTYITEQNREEGPWSIVKQVGVGIQKPTLVQIGKDRFDTRLIRNLIFITNIQRLLRLRLNLELSQFRNVLVSPDHIINPSITEYGFSITGPSETFSDKQYDSDIRIL

SEQ ID NO: 258 - protein, 9 aa, African swine fever virus
EFYQKLFSF

SEQ ID NO: 259 - protein, 9 aa, African swine fever virus
IPIYLKENY

SEQ ID NO: 260 - protein, 9 aa, African swine fever virus
YINQALHEI

SEQ ID NO: 261 - protein, 9 aa, African swine fever virus
HNKQEFQSY

SEQ ID NO: 262 - protein, 9 aa, African swine fever virus
ITKTFVNNI

SEQ ID NO: 263 - protein, 9 aa, African swine fever virus
DNAPAGHYY

SEQ ID NO: 264 - protein, 10 aa, African swine fever virus
NIRDLIGRSL

SEQ ID NO: 265 - protein, 10 aa, African swine fever virus
TAEEAAQRVY

SEQ ID NO: 266 - protein, 9 aa, African swine fever virus
VNDALSTRW

SEQ ID NO: 267 - protein, 9 aa, African swine fever virus
MKTKHVIKL

SEQ ID NO: 268 - protein, 15 aa, African swine fever virus
SFPLCLEMGVVKVFE

SEQ ID NO: 269 - protein, 15 aa, African swine fever virus
KNNGIDVNSIYGSDD

SEQ ID NO: 270 - DNA, 45 bp, African swine fever virus
tccttccccctgtgcctggagatgggcgtggtcaaagtcttcgag

SEQ ID NO: 271 - DNA, 45 bp, African swine fever virus
aaaaacaacggcatcgacgtgaacagcatttatggcagcgatgat

SEQ ID NO: 272 - protein, 312 aa, African swine fever virus
MLLVKMTTHIFHADDLLQALQQAKAEKNFSSVFSLDWDKLRTAKRNTTVKYVTVNVIVKGKKAPLMFNFQNEKHVGTIPPSTDEEVIRMNAENPKFLVKKRDRDPCLQFNKYKISPPLEDDGLTVKKNEQGEEIYPGDEEKSKLFQIIELLEEAFEDAVQKGPEAMKTKHVIKLIQRKISNSAVKNADKPLPNPIARIRIKINPATSILTPILLDKNKPITLQNGKTSFEELKDEDGVKANPDNIHKLIESHSMHDGIINARSICISNMGISFPLCLEMGVVKVFEKNNGIDVNSIYGSDDISTLVNQIAIA

SEQ ID NO: 273 - DNA, 924 bp, African swine fever virus
atgactacacacatctttcacgcagatgatctcctacaagcattgcaacaagcaaaagcagaaaaaaatttttcatctgtattttctttagattgggataaattacgcacagcgaagcgtaatacaacggttaaatatgttacggtcaatgtcatagtaaaaggcaaaaaagctccgctaatgtttaactttcaaaatgaaaaacatgtaggaaccattcctcccagtaccgatgaagaggttatacggatgaatgctgaaaatccaaagtttttggtgaaaaaacgtgacagggatccctgtttgcagttcaacaaatacaaaatctcgccgccattggaagatgatggtctcactgttaaaaagaatgagcagggtgaagaaatataccccggcgacgaagaaaaatctaagttgtttcaaattattgaactgttagaagaagcctttgaagacgctgtgcaaaaaggtcctgaagccatgaaaacgaaacatgttataaaattaattcaaagaaaaatttctaatagcgcggttaaaaacgcagacaaacctttgccgaatcctatcgcacgcattcgtattaaaatcaatcccgctacaagtatactaacaccaatattgcttgataaaaataagcccattactttacagaatggtaaaacaagctttgaagagttaaaagatgaagacggcgttaaggccaatccggataatattcataagcttatagaatcgcattctatacatgatggcatcattaatgctagatctatttgcatcagcaatatgggcatttcatttccgctttgcttggaaatgggagttgtaaaagtttttgaaaaaaataatgggattgatgtgaactccatttatggctcagacgatatttcaactcttgttaatcagattgctattgcttaa

SEQ ID NO: 274 - protein, 307 aa, African swine fever virus
MTTHIFHADDLLQALQQAKAEKNFSSVFSLDWDKLRTAKRNTTVKYVTVNVIVKGKKAPLMFNFQNEKHVGTIPPSTDEEVIRMNAENPKFLVKKRDRDPCLQFNKYKISPPLEDDGLTVKKNEQGEEIYPGDEEKSKLFQIIELLEEAFEDAVQKGPEAMKTKHVIKLIQRKISNSAVKNADKPLPNPIARIRIKINPATSILTPILLDKNKPITLQNGKTSFEELKDEDGVKANPDNIHKLIESHSIHDGIINARSICISNMGISFPLCLEMGVVKVFEKNNGIDVNSIYGSDDISTLVNQIAIA

SEQ ID NO: 275 - protein, 11 aa, African swine fever virus
LIDFDPLVTFY

SEQ ID NO: 276 - protein, 10 aa, African swine fever virus
VTFYLLLEPY

SEQ ID NO: 277 - protein, 8 aa, African swine fever virus
STINALRF

SEQ ID NO: 278 - protein, 530 aa, African swine fever virus
MPSNMKQFCKISVWLQQHDPDLLEIINNLCMLGNLSAAKYKHGVTFIYPKQAKIRDEIKKHAYSNDPSQAIKTLESLILPFYIPTPAEFTGEIGSYTGVKLEVEKTEANKVILKNGEAVLVPAADFKPFPDRRLAVWIMESGSMPLEGPPYKRKKEGGGNDPPVPKHISPYTPRTRIAIEVEKAFDDCMRQNWCSVNNPYLAKSVSLLSFLSLNHPTEFIKVLPLIDFDPLVTFYLLLEPYKTHGDDFLIPETILFGPTGWNGTDLYQSAMLEFKKFFTQITRQTFMDIADSATKEVDVPICYSDPETVHSYANHVRTEILHHNAVNKVTTPNLVVQAYNELEQTNTIRHYGPIFPESTINALRFWKKLWQDEQRFVIHGLHRTLMDQPTYETSEFAEIVRNLRFSRPGNNYINELNITSPAMYGDKHTTGDIAPNDRFAMLVAFINSTDFLYTAIPEEKVGGNETQTSSLTDLVPTRLHSFLNHNLSKLKILNRAQQTVRNILSNDCLNQLKHYVKHTGKNEILKLLQE

SEQ ID NO: 279 - protein, 10 aa, African swine fever virus
RTHLITTLDY

SEQ ID NO: 280 - protein, 80 aa, African swine fever virus
MLIPVVCFTCGFPIGTYAAIFDKARTEYIKTKMGGTLPQNIPLDASLQIELKDLITALGIPMRVCCRTHLITTLDYRKYY

SEQ ID NO: 281 - protein, 10 aa, African swine fever virus
EPMEQVLIHY

SEQ ID NO: 282 - protein, 11 aa, African swine fever virus
GPDPKISSNAY

SEQ ID NO: 283 - protein, 10 aa, African swine fever virus
HNAQLFVQNF

SEQ ID NO: 284 - protein, 11 aa, African swine fever virus
TPDGGPELAKY

SEQ ID NO: 285 - protein, 9 aa, African swine fever virus
YKDETLPYL

SEQ ID NO: 286 - DNA, 27 bp, African swine fever virus
tataaagacgaaacattgccgtactta

SEQ ID NO: 287 - protein, 9 aa, African swine fever virus
YKDETLPYL

SEQ ID NO: 288 - DNA, 27 bp, African swine fever virus
tataaagacgaaacattgccgtactta

SEQ ID NO: 289 - protein, 9 aa, African swine fever virus
KTWHEIPLY

SEQ ID NO: 290 - protein, 10 aa, African swine fever virus
GMQDGIRWFY

SEQ ID NO: 291 - protein, 11 aa, African swine fever virus
RQFMNHYMNFI

SEQ ID NO: 292 - protein, 11 aa, African swine fever virus
TVLNTFEAYGY

SEQ ID NO: 293 - protein, 9 aa, African swine fever virus
FMARPVWTY

SEQ ID NO: 294 - protein, 9 aa, African swine fever virus
ALALISLCY

SEQ ID NO: 295 - protein, 1133 aa, African swine fever virus
MAYPELDAADFLQQLARRKEFKSLISPPVDQKELIRDLRAHFVQIGGPGCEKGGRAFFPCDPYASPFPSIKGLQLHNAQLFVQNFQNPNTPYSRLLLNWQTGTGKSIAAIAIARQFMNHYMNFIENAPWIFVVGFTRAIIQTEMLRRPELGFVSYKEVAELHRLLHIAKQSGSTTSVESRHLNGFVSTLKRRLTDRNRGGFFQFYGYKEFASKLFNITSKGEEKNFDVLSLFHRSDEAEDTLNENDISQFVQKISEAETNGLIRVNQKIMEQLRGGLLIADEIHNVYNIQERNNYGIALQYVLDAFPPHQAPRAVFMSATPVTGSVMEYVDLLNLLVPRHELPNGQPLQRQQLFDSSGHSVKWKKDALALVERLSTGRVSFLLDTNTNFYPERIFAGKMLSYKDETLPYLHFIECPMSEYQLETLKQLGPDPKISSNAYSIYDMVFPNPKFSKQTEPKAYGLFNSTETPTALSMASTDWLLENGVQIIEPSRRAPFNVSGSFLSLQPPTHISGLAFYSGKYTQMMKDILSIIRQGRGKILIYHNRVRMSGVLILQEILQSNGILNEVSSPVGTTRCSICAAIRDEHTHSDHQFIPVRFTILHSEIEPAVRERSLALFNASSNLEGHQLRILIGSKVIVEGLNFQAVRYEMIMSLPLDIPRLIQVFGRVVRKNSHMELPPSERNVTIYLYVSTTPDGGPELAKYAQKLKEYILIQEGDKALRKHAIDGFTNQIKIDKPMLESLPLSPSITPANVGATVLNTFEAYGYGEQEVKTISNIIISLFMARPVWTYSELWKAVSTPKLIQGITIDNKLFSEDNFALALISLCYSKNQCKELWIQNRLCTIMHVPAKPEHLYVAAVLNHKKEPVLDIETYIRDFQLPAMHSIRITKYLEHSQTKEPFQVLYEKFQKDFQDEPMEQVLIHYPASFHYTMLEALIIDNLAGMGALVEVYKKFFIAFSKKDIQPFPDIFKIISHVPGDDNTLVGYATEDSVRLITSREDKTWHEIPLYMLNINVKRKENDIVIGYMESKGKALKFKIRPPIQVLKKNEITDIRMLNRGAVCETRGREEQQKIADQLGISLNLTKISAIKLCLLIRNNLLQKEMEARNQPNGMQDGIRWFYLFNDKMPSLVHTS

SEQ ID NO: 296 - DNA, 3402 bp, African swine fever virus
atggcgtatcccgaattggatgccgcagactttttgcagcagttggcgcgaagaaaggagtttaagtcgttgatttcccctcctgtcgaccaaaaagagctcattcgtgatctgcgggctcattttgtccagatcggtgggcctggctgcgagaagggggggcgagcgttttttccgtgtgacccctacgcgtcgccctttccttccatcaagggtctccaattgcataatgcccagcttttcgtccaaaactttcaaaaccccaacacaccctactcgcgtcttttattaaactggcagaccgggacgggaaaaagcattgccgcgattgccattgcgcgccaattcatgaaccactacatgaattttattgaaaatgcgccctggatttttgtggtaggctttacacgcgccatcattcaaacagaaatgctaagacgtcctgagctgggatttgtttcttacaaggaggtcgctgagctacaccggcttcttcacattgcaaagcagtctggcagcaccacgtcggttgaatcacggcatctaaatgggttcgttagtacgttaaagcgccgtttaaccgatagaaaccgcggaggcttttttcagttttacggctataaggaatttgcatccaagcttttcaatattacgagtaagggtgaagagaaaaactttgatgtgctttctctgtttcatcgttctgacgaagcagaagatacattgaatgagaacgatatatctcagttcgtgcaaaaaatcagcgaggccgagacaaacggcctcatccgggtgaatcaaaaaatcatggagcagcttaggggaggactgctcattgcggatgaaatacacaacgtgtacaatatccaggaacgaaataattatggcatcgctttacagtatgtcctggatgcctttccacctcaccaggcccccagggccgtcttcatgtcggcaacgcccgtaaccgggagtgtcatggaatacgtcgacctgttaaaccttttggttccgcggcatgagctgcccaacggccagcccctccagcgccagcaactgtttgacagcagtgggcattccgttaaatggaaaaaggacgccctggctcttgtggaaagactcagcaccggaagggtatcttttttgttggataccaacaccaatttttatcctgaaagaatatttgccggaaagatgttgtcctataaagacgaaacattgccgtacttacatttcatcgaatgccccatgtctgagtatcagcttgaaacgcttaaacagctgggccctgaccctaaaatctcgagtaatgcgtacagcatttatgacatggtgtttcccaacccaaaattttcaaaacaaacggaacccaaggcttacggcctgtttaactcgacggaaacccccactgccctttctatggcaagcacagactggcttctggaaaacggggtacagattattgagccttcgcgtagagccccctttaatgtgagtggcagctttttgtcgctgcagccaccaacgcacatctcgggattggccttttatagcggaaaatacactcaaatgatgaaagacattctttccattattcggcaaggccgggggaaaattttaatttaccacaatcgggtccgcatgtcgggggttcttatcctgcaagaaattttacaaagtaatggcattttaaatgaagtttcgtcccctgtgggaacgacccgctgctccatctgcgccgcgattcgcgatgagcacacacatagcgaccatcagtttattccagtacggttcaccattctgcacagcgaaatagagcccgctgtacgcgaacgaagcctggctctttttaacgcctcgtccaacctggaaggccaccagctgcgtattctcatcgggtccaaggtgattgtggagggtttgaactttcaggccgtgcggtacgagatgattatgtcattgccccttgatattccccggcttattcaggtatttgggagggtggtgcgaaaaaattcacacatggagcttccccccagtgagcgcaacgtgacaatctatttgtacgtatcgacaacacccgatggagggccagagcttgctaagtacgcacaaaaattaaaagaatacattttaatacaggagggggataaggcgctgcgaaagcacgccattgatgggttcaccaaccagattaagattgataagcctatgctggaaagtctgccccttagtccatccatcacgccggcaaacgtcggagccaccgtcctcaatacctttgaggcctatggatacggggagcaagaggtaaaaacaatttctaatattattatatctttgtttatggcacgccccgtgtggacgtactccgagctatggaaggcagtttccacgcccaagctcatacagggaattaccatcgataataaactcttctcagaggacaacttcgcgctggcgctcatttctctatgctactcaaaaaaccagtgcaaggaattatggatacagaatcgtctttgcaccattatgcatgtgccggcaaagcctgagcatttgtacgtcgctgcggtgcttaaccataaaaaggaaccggtattagatattgaaacatatattcgggattttcagcttcccgcgatgcacagcatccgtattaccaaatacctcgaacactcgcagaccaaagaaccctttcaagtattgtatgaaaagtttcagaaggattttcaggatgagccaatggagcaggtactcatccattatcccgcttcatttcactatacgatgctagaagcacttattatagataatcttgcaggtatgggggcccttgtcgaggtttataaaaagtttttcatcgctttttcaaaaaaagatattcagccatttccggacatttttaaaattataagccacgtgcctggggatgacaacactctggtgggctatgccacggaggactccgtgcgacttattacctcgcgagaagataaaacctggcatgaaattccgctctatatgcttaatattaatgttaaacgaaaagaaaacgacattgtcataggctatatggaaagcaagggaaaggcccttaaatttaaaatccgcccacctatccaggttttaaaaaagaacgagattactgatattcgcatgctaaaccggggagccgtatgcgaaacacgcggacgggaggagcaacaaaaaattgctgaccaattgggcataagtttaaaccttacaaagattagtgccatcaagctctgcttactcattcgcaataaccttttgcaaaaagaaatggaggctcgtaatcaaccaaatggaatgcaggatggaatccgctggttttacctttttaacgacaaaatgccgtcacttgtgcacacatcttag

SEQ ID NO: 297 - protein, 1133 aa, African swine fever virus
MAYPELDAADFLQQLARRKEFKSLISPPVDQKELIRDLRAHFVQIGGPGCEKGGRAFFPCDPYASPFPSIKGLQLHNAQLFVQNFQNPNTPYSRLLLNWQTGTGKSIAAIAIARQFMNHYMNFIENAPWIFVVGFTRAIIQTEMLRRPELGFVSYKEVAELHRLLHIAKQSGSTTSVESRHLNGFVSTLKRRLTDRNRGGFFQFYGYKEFASKLFNITSKGEEKNFDVLSLFHRSDEAEDTLNENDISQFVQKISEAETNGLIRVNQKIMEQLRGGLLIADEIHNVYNIQERNNYGIALQYVLDAFPPHQAPRAVFMSATPVTGSVMEYVDLLNLLVPRHELPNGQPLQRQQLFDSSGHSVKWKKDALALVERLSTGRVSFLLDTNTNFYPERIFAGKMLSYKDETLPYLHFIECPMSEYQLETLKQLGPDPKISSNAYSIYDMVFPNPKFSKQTEPKAYGLFNSTETPTALSMASTDWLLENGVQIIEPSRRAPFNVSGSFLSLQPPTHISGLAFYSGKYTQMMKDILSIIRQGRGKILIYHNRVRMSGVLILQEILQSNGILNEVSSPVGTTRCSICAAIRDEHTHSDHQFIPVRFTILHSEIEPAVRERSLALFNASSNLEGHQLRILIGSKVIVEGLNFQAVRYEMIMSLPLDIPRLIQVFGRVVRKNSHMELPPSERNVTIYLYVSTTPDGGPELAKYAQKLKEYILIQEGDKALRKHAIDGFTNQIKIDKPMLESLPLSPSITPANVGATVLNTFEAYGYGEQEVKTISNIIISLFMARPVWTYSELWKAVSTPKLIQGITIDNKLFSEDNFALALISLCYSKNQCKELWIQNRLCTIMHVPAKPEHLYVAAVLNHKKEPVLDIETYIRDFQPPAMHSIRITKYLEHSQTKEPFQVLYEKFQKDFQDEPMEQVLIHYPASFHYTMLEALIIDNLAGMGALVEVYKKFFIAFSKKDIQPFPDIFKIISHVPGDDNTLVGYATEDSVRLITSREDKTWHEIPLYMLNINVKRKENDIVIGYMESKGKALKFKIRPPIQVLKKNEITDIRMLNRGAVCETRGREEQQKIADQLGISLNLTKISAIKLCLLIRNNLLQKEMEARNQPNGMQDGIRWFYLFNDKMPSLVHTS

SEQ ID NO: 298 - DNA, 3402 bp, African swine fever virus
atggcgtatcccgaattggatgccgcagactttttgcagcagttggcgcgaagaaaggagtttaaatcgttgatttcccctcctgtcgaccaaaaagagctcattcgtgatctgcgggctcattttgtccagatcggtgggcctggctgcgagaagggggggcgagcgttttttccgtgtgacccctacgcgtcgccctttccttccatcaagggtctccaattgcataatgcccagcttttcgtccaaaactttcaaaatcccaacacgccctactcgcgtcttttattaaactggcagaccgggacgggaaaaagcattgccgcgattgccatcgcgcgtcaatttatgaaccactacatgaattttattgaaaatgcgccctggatttttgtggtaggctttacacgcgccatcattcaaacagaaatgctaagacgtcctgagctgggatttgtttcttacaaggaggtcgctgagctacaccggcttcttcacattgcaaagcagtctggcagcaccacgtcggtcgaatcacggcatctaaatgggttcgttagtacgttaaagcgccgtttaaccgatagaaaccgcggaggcttttttcagttttacggctataaggaatttgcatccaagcttttcaatattacgagtaagggtgaagagaaaaactttgatgtgctttctctgtttcatcgttctgacgaagcagaagatacattgaatgagaacgatatatctcagttcgtgcaaaaaattagcgaggccgagacaaacggcctcatccgggtgaatcaaaaaatcatggagcaacttaggggaggactgctcattgcggatgaaatacacaacgtgtacaatatccaggaacgaaataattatggcatcgctttacagtatgtcctggatgcctttccacctcaccaggcccccagggccgtcttcatgtcggcaacgcccgtaaccgggagtgtcatggaatacgtcgacctgttaaaccttttggttccgcggcatgagctgcccaacggccagcccctccagcgccagcaactgtttgacagcagtgggcattccgttaaatggaaaaaggacgccctagctcttgtggaaagactgagcaccggaagggtatcttttttgttggataccaacaccaatttttaccccgaaagaatatttgccggaaagatgttgtcctataaagacgaaacattgccgtacttacatttcatcgaatgccccatgtctgagtatcagcttgaaacgcttaaacagctgggccctgaccctaaaatctcgagtaatgcgtacagcatttatgacatggtgtttcccaacccaaaattttcaaaacaaacggaacccaaggcttacggcctgtttaactcgacggaaacccccaccgccctttctatggcaagcacagactggcttctggaaaacggggtacagattattgagccttcgcgtagagccccctttaatgtgagtggcagctttttgtcgctgcagccaccaacgcacatctcgggattggccttttatagcggaaaatacactcaaatgatgaaagacattctttccattattcggcaaggccgggggaaaattttaatttaccacaatcgggtccgcatgtcgggggttcttatcttgcaagaaattttacaaagtaatggcattttaaatgaagtttcgtcccctgtgggaacgacccgctgctccatctgcgccgcgattcgcgatgagcacacacatagcgaccatcagtttattccagtacggttcaccattctgcacagcgaaatagagcccgctgtacgcgaacgaagcctggctctttttaacgcctcgtccaacctggaaggccaccagctgcgtattctcatcgggtccaaggtgattgtggagggtttgaactttcaggccgtgcggtacgagatgattatgtcattgccccttgatattccccggcttattcaggtatttgggagggtggtgcgaaaaaattcacacatggagctcccccccagtgagcgcaacgtgacaatttatttgtacgtatcgacaacacccgatggagggccagagctcgctaagtacgcacaaaaattaaaagaatacattttaatacaggagggggataaggcgctgcgaaagcacgccattgatgggttcaccaaccagattaagattgataagcctatgttggaaagtctgccccttagtccatccatcacgccggcaaacgtcggagccaccgtcctcaatacctttgaggcctatggatacggggagcaagaggtaaaaacaatttctaatattattatatctttgtttatggcacgccccgtgtggacgtactccgagctatggaaggctgtttccactcccaagctcatacagggaattaccatcgataataaactcttctcagaggacaacttcgcgctggcgctcatttctctatgctactcaaaaaaccagtgcaaggaattatggatacagaatcgtctttgcaccattatgcatgtgccggcaaagcctgagcatttgtacgtcgctgcggtgcttaaccataaaaaggaaccggtattagatattgaaacatatattcgggattttcagcctcccgcgatgcacagcatccgtattaccaaatacctcgaacactcgcagaccaaagaaccctttcaagtattgtatgaaaagtttcagaaggattttcaggatgagccaatggagcaggtactcatccactaccccgcttcatttcactatacgatgctagaagcacttattatagataatcttgcaggtatgggggcccttgtcgaggtttataaaaagtttttcatcgctttttcaaaaaaagatattcagccatttccggacatttttaaaattataagccacgtgcctggggatgacaacactctagtgggctatgccacggaggactccgtgcgacttattacctcgcgagaagataaaacctggcatgaaattccgctttatatgcttaatattaatgttaaacgaaaagaaaacgacatcgtcataggctatatggaaagcaagggaaaggcccttaaatttaaaatccgcccacctatccaggttttaaaaaagaatgagattactgatattcgcatgctaaaccggggagccgtatgcgaaacacgcggacgggaggagcaacaaaaaattgctgaccaattgggcataagtttaaaccttacaaagattagtgccatcaagctctgcttactcattcgcaataaccttttgcaaaaagaaatggaggctcgtaatcaaccaaatggaatgcaggatggaatccgctggttttacctttttaacgacaaaatgccgtcacttgtgcacacatcttag

SEQ ID NO: 299 - protein, 10 aa, African swine fever virus
HNAQLFVQNF

SEQ ID NO: 300 - protein, 9 aa, African swine fever virus
YKDETLPYL

SEQ ID NO: 301 - protein, 11 aa, African swine fever virus
GPDPKISSNAY

SEQ ID NO: 302 - protein, 10 aa, African swine fever virus
EPMEQVLIHY

SEQ ID NO: 303 - protein, 10 aa, African swine fever virus
EFIEYRKMVL

SEQ ID NO: 304 - protein, 11 aa, African swine fever virus
EFIEYRKMVLL

SEQ ID NO: 305 - protein, 9 aa, African swine fever virus
VPYDKFVQM

SEQ ID NO: 306 - protein, 19 aa, African swine fever virus
MAMQKLFTYIYEFIEYRKM

SEQ ID NO: 307 - protein, 10 aa, African swine fever virus
AMQKLFTYIY

SEQ ID NO: 308 - protein, 9 aa, African swine fever virus
KLFTYIYEF

SEQ ID NO: 309 - protein, 11 aa, African swine fever virus
FTYIYEFIEYR

SEQ ID NO: 310 - protein, 8 aa, African swine fever virus
YIYEFIEY

SEQ ID NO: 311 - protein, 205 aa, African swine fever virus
MAMQKLFTYIYEFIEYRKMVLLEEKVPYDKFVQMVLNTGFFRINAETLNHGIVSVFIFGANGKYVHHGGDMRTLLTNTLNEKKHYEELILIVDKPVLSKKNILDIIVEQRAANPTIVINIYPYHLFCINIPKVSAIPKHKLITQEEAQEFLGREYLQPQDLMQISASDPPVVWLGGRPGDFVQIERPSETAMHAVVIRFITKSKI

SEQ ID NO: 312 - protein, 205 aa, African swine fever virus; identical to SEQ ID NO: 311

SEQ ID NO: 313 - protein, 9 aa, African swine fever virus
TAMQLKTSI

SEQ ID NO: 314 - protein, 11 aa, African swine fever virus
SMSYFDGKTEY

SEQ ID NO: 315 - protein, 9 aa, African swine fever virus
TEYKHIYFL

SEQ ID NO: 316 - protein, 17 aa, African swine fever virus
KRYSLAFSEFIHCHYSI

SEQ ID NO: 317 - protein, 10 aa, African swine fever virus
AFSEFIHCHY

SEQ ID NO: 318 - protein, 250 aa, African swine fever virus; identical to SEQ ID NO: 112

SEQ ID NO: 319 - protein, 250 aa, African swine fever virus; identical to SEQ ID NO: 113

SEQ ID NO: 320 - protein, 9 aa, African swine fever virus
RSKKDFKQI

SEQ ID NO: 321 - protein, 339 aa, African swine fever virus
MIDQKIFETTLNIDDPTNFCTNVEAHLLKELENIYVGKCFKNSFILNITGVIQRSPCFIMRTNNSGRGYMHVRFSAVVSYLNAFDLIAAVKIIKNDSNIILGESLLTEPVTIVIPSSESQNNVAEVGQIVPVQLANSSVYYIPGRQQASATGSIFIPKHTFSVYHVQEELTQEQALNLTKLVNIIEMLLESRSKKDFKQICFFEKLYYTYSISSDEILDLKIWKGPKGKEMSRLKPCNVLSFLYDALKNKSSSLGFWARPPNLLKSSPLAYQQDQNSFNATELPIICSAEVMFVTLLKEIINYLQFMNDLCDTFNNEQLIKRHENIWMLIEQRKIGHDF

SEQ ID NO: 322 - protein, 339 aa, African swine fever virus
MIDQKIFETTLNIDDPTNFCTNVEAHLLKELENIYVGKCFKNSFILNITGVIQRSPCFIMRTNNSGRGYMHVRFSAVVSYLNAFDLIAAVKIIKNDSNIILGESLLTEPVTIVIPSSESQNNVAEVGQIVPVQLANSSVYYIPGRQQASATGSIFIPKHTFSVYHVQEELTQEQALNLTKLVNIIEMLLESRSKKDFKQICFFEKLYYTYSISSDEILDLKIWKGPKGKEMSRLKPCNVLSFLYDALKNKNSSLGFWARPPNLLKSSPLAYQQDQNSFNATELPIICSAEVMFVTLLKEIINYLQFINDLCDTFNNEQLIKRHENIWMLIEQRKIGHDF

SEQ ID NO: 323 - protein, 9 aa, African swine fever virus
KTIFNNVRY

SEQ ID NO: 324 - protein, 345 aa, African swine fever virus; identical to SEQ ID NO: 115

SEQ ID NO: 325 - protein, 9 aa, African swine fever virus
YSEKEKETI

SEQ ID NO: 326 - protein, 238 aa, African swine fever virus
MARGQNIRKRTFSDMDTPSDKNIGIHTNSLPKNNLYRRILFKGKISNYSISKDSLAKDHSSKHSISKNGLIGKKRPAPLDISFQSMNSSISSSTQKKTRILDEEIKDQSLSNENDTDSPVIVDITLKPSYMSKTSRITEIIHKMKELNMNRIEDGSSFNKKRSEHDDKNILLHTMEMEEEDCEIEEDIAIDSPYLNTSLSEDDTDSIVGTDYSEKEKETISETESSSDDESYSLYDSF

SEQ ID NO: 327 - protein, 238 aa, African swine fever virus
MARGQNIRKRTFSDMDTPSDKNIGIHTNSLPKNNLYRRILFKGKISNYSISKDSLAKDHSSNHSISKNGLIGKKRPAPLDISFQNMNSSISSSTQKKTRILDEEIKDQSLSNENDRDSPVIVDITLKPSYMSKTSRITEIIHKMKELNMNRIEDGSSFNKKRSEHDDKNILLHTMEMEEEDCEIEEDIAIDSPYLNTSLSEDDTDSIVGTDYSEEEKETISETESSSDDESYSLYDSF

SEQ ID NO: 328 - protein, 10 aa, African swine fever virus
MTSSEWIAEY

SEQ ID NO: 329 - protein, 96 aa, African swine fever virus; identical to SEQ ID NO: 119

SEQ ID NO: 330 - protein, 8 aa, African swine fever virus
YNIKTKEY

SEQ ID NO: 331 - protein, 111 aa, African swine fever virus; identical to SEQ ID NO: 120

SEQ ID NO: 332 - protein, 111 aa, African swine fever virus; identical to SEQ ID NO: 120

SEQ ID NO: 333 - protein, 8 aa, African swine fever virus
LTHNMEKI

SEQ ID NO: 334 - protein, 120 aa, African swine fever virus; identical to SEQ ID NO: 122

SEQ ID NO: 335 - protein, 122 aa, African swine fever virus; identical to SEQ ID NO: 123

SEQ ID NO: 336 - protein, 13 aa, African swine fever virus
IAYMRFRNCVFTF

SEQ ID NO: 337 - protein, 10 aa, African swine fever virus
MRFRNCVFTF

SEQ ID NO: 338 - protein, 146 aa, African swine fever virus
MGGTTDFVLSITIVLVILIIIAFIWYNFTGWSPFKYSKGNTVTFKTPDESSIAYMRFRNCVFTFTDPKGSLHSIDVTEVLNNMAKGFRDAQNPPSSFTLGGHCQAPLNAFSFVLPGVNDRATVATADEAKKWENCDATLTGLQRII

SEQ ID NO: 339 - protein, 146 aa, African swine fever virus; identical to SEQ ID NO: 338

SEQ ID NO: 340 - protein, 10 aa, African swine fever virus
YTHKDLENSL

SEQ ID NO: 341 - protein, 183 aa, African swine fever virus
MDSEFFQPVYPRHYGECLSPVTPPSFFSTHMYTILIAIVVLVIIIIVLIYLFSSRKKKAAAAIEEEDIQFINPYQDQQWAEVTPQPGTSKPAGATTASAGKPVTGRPATNRPATNKPVTDNPVTDRLVMATGGPAAAPAAASVHPTEPYTTVTTQNTASQTMSAIENLRQRNTYTHKDLENSL

SEQ ID NO: 342 - protein, 184 aa, African swine fever virus; identical to SEQ ID NO: 127

SEQ ID NO: 343 - protein, 10 aa, African swine fever virus
TNTVNQYSHY

SEQ ID NO: 344 - protein, 248 aa, African swine fever virus; identical to SEQ ID NO: 132

SEQ ID NO: 345 - protein, 248 aa, African swine fever virus; identical to SEQ ID NO: 133

SEQ ID NO: 346 - protein, 9 aa, African swine fever virus
NTITLNNTI

SEQ ID NO: 347 - protein, 8 aa, African swine fever virus
LMLNTITL

SEQ ID NO: 348 - protein, 301 aa, African swine fever virus; identical to SEQ ID NO: 136

SEQ ID NO: 349 - protein, 301 aa, African swine fever virus; identical to SEQ ID NO: 137

SEQ ID NO: 350 - protein, 18 aa, African swine fever virus
RSRTASSAELYRKMLYAY

SEQ ID NO: 351 - protein, 8 aa, African swine fever virus
LVDHIFNY

SEQ ID NO: 352 - protein, 423 aa, African swine fever virus
MLWRNEITEFMDQLSKYSQEILKTFKQLRPSEYKQYNEFLTQVTPLLQKTPEKIPELVDHIFNYLDNVEKICELLVNASSIIISSKIREQVKHGMSFSYKADLDSLADILSQKQYVLMHLSKNIAAEYFNTCLNQGKSKLDLKAASVFYSSRSRTASSAELYRKMLYAYGSPQEINYYTEKARNKTLDVEESDSMAIIERTARHNLSLMHPLEAMGLTFGATNTDADPEDLKDKTVINLTLPQATESITYHLKSLMQLKKVSTASGLNTNILKAFDNIISTPVKKNKMASKLAPGMDVVFTSDNGKTFFTKNILSKNMLAGPKERVFAYNNLISNLNNSCFIQNHNDFLRQQDSWPFYDAHNFTNKFLMQPIFSGQTRPRLQGAMEAAHVETHLTAFLQSIQPSRPQDPSVLASPKLSALILN

SEQ ID NO: 353 - protein, 10 aa, African swine fever virus
LTHNHILFTY

SEQ ID NO: 354 - protein, 10 aa, African swine fever virus
SIITRYTLKY

SEQ ID NO: 355 - protein, 66 aa, African swine fever virus
MLTMVSLARFIINTASFNKSIYPLSQVYVKIHLSHKYNHILFTYNMRIYLIKRNHMLFTHMLISCN

SEQ ID NO: 356 - protein, 50 aa, African swine fever virus
MHISIITRYTLKYIYMHLTHNHILFTYIMRIYLIKHNHMLFTTHVYTYIM

SEQ ID NO: 357 - protein, 9 aa, African swine fever virus
RVHGSGVSL

SEQ ID NO: 358 - protein, 10 aa, African swine fever virus
TNAFELAQRY

SEQ ID NO: 359 - protein, 9 aa, African swine fever virus
QMFNVDITY

SEQ ID NO: 360 - protein, 11 aa, African swine fever virus
RVDMNRFFQFY

SEQ ID NO: 361 - protein, 1242 aa, African swine fever virus
MEPLRPQITYGPIETVDNEELTEADMLSFISAAVNSTGLIGYNIKSFDDLMDNGIPQIVKQMFNVDITYKDQRDHTEIDKLRESVQIQFNFTDVNIERPQHRNYSQGNKINLLPNKARLCGLSYSGPVNLAAEVILTAHYSNGRQEVKRASIPPFQVSTFPIMRGSNRCHTHHLSKTAKKEIGEDPNEPGGYFIARGGEWVVDLLENIRFNTLHIHYHTMQQGNNEIIRGEFISQPGGAFENSSQIIIRYMTTGAITIEINSTKFSKLRIPWYLIFRMFGMTGDDSIIEQVVFDLESNSPVNTFMIEILEKSIHVLDPIFQPVQHELNREKIIQFLSEKVSKFVSNPSAYKSDENAVQYLNERQLTILDKILLPHMGQTADTRVRKLRFLGLLIHKILLVIMNVFPPTDRDSYRTKRVHGSGVSLAKAFKAIFNTSVIAPIINGFKELLKQTAFEELTQRNIIEAFSAALSKNTASDLNRSMEQSIISGNKTIMVRQRPIVNRVSTQSLERKNLLNTISALRTVNTHNTTNASKQTERADMMRRVHASYPGYICVAQSADTGEKVGMSKQLAITANVCTAGEVLSLKQRLLSDPAIQQLADVSNKDIVRKGLARVFINGEWIGCCTNAFELAQRYRMFRREGKIVHPHTTIYWDSMVDEVEFWLDVGRLTRPLLIVDNNIEKYNQACYKAAEARKKGDKDWEKHKIPFIQNTRFTSQMAKDILAGTLTLEDLVAQGICEFITPEEAENCLVAFSIIELRKHKHDVTRRFTHVDVPQAILGLAALVSPYANCTQPARVTYETNQGRQTGGWYCFSWPYRVDMNRFFQFYNEMPLVKTIAHNYVIPNGLNTIVAYMIYGGYNQEDSVIVSQSFIDRGGFAGTFYREEKVELESDIESFGKPDPLITKNLKPGANYEKLVDGFVPVGTVVKKGDIIIGKVAKIRGEKDELNKYIDRSVMYGFDEPAVVDAVMRPHGPNDEIFGLMRLRYERNLNIGDKMSSRSGNKGIAALALPTSDMPFTEDGLQPDLIVNPHSHPSRMTNGQMIETTVGLANALQGVVTDGTAFLPINVQLLSERLAQEGLRFNGCQKMFNGQTGEYFDAAIFIGPTYHQRLQKFVLDDRYAVASYGPTDALTGQPLDGKRSHGGLRLGEMEHWVLTAQGAMQTIIEKSHDDSDGCISYICRNCGEPAIYNASHPIYKCMNCDVQADIGMVDSRRSSIVFQHEMRAANVNITSVLSPRVFQPA

SEQ ID NO: 362 - protein, 1242 aa, African swine fever virus
MEPLRPQITYGPIETVDNEELTEADMLSFISAAVNSTGLIGYNIKSFDDLMDNGIPQIVKQMFNVDITYKDQRDHTEIDKLRESVQIQFNFTDVNIERPQHRNYSQGNKINLLPNKARLCGLSYSGPVNLAAEVILTAHYSNGRQEVKRASIPPFQVSTFPIMRGSNRCHTHHLSKTAKKEIGEDPNEPGGYFIARGGEWVVDLLENIRFNTLHIHYHTMQQGNNEIIRGEFISQPGGAFENSSQIIIRYMTTGAITIEINSTKFSKLRIPWYLIFRMFGMTGDDSIIEQVVFDLESNSLVNTFMIEILEKSIHVLDPIFQPVQHELNREKIIQFLSEKVSKFVSNPSAYKSDENAVQYLNERQLTILDKILLPHMGQTADTRVRKLRFLGLLIHKILLVIMNVFPPTDRDSYRTKRVHGSGVSLAKAFKAIFNTSVIAPIINGFKELLKQTAFEELTQRNIIEAFSAALSKNTASDLNRSMEQSIISGNKTIMVRQRPIVNRVSTQSLERKNLLNTISALRTVNTHNTTNASKQTERADMMRRVHASYPGYICVAQSADTGEKVGMSKQLAITANVCTAGEVLSLKQRLLSDPAIQQLADVSNKDIVRKGLARVFINGEWIGCCTNAFELAQRYRMLRREGKVVHPHTTIYWDSMVDEVEFWLDVGRLTRPLLIVDNNIEKYNQACYKAAEARKKGDKDWEKHKIPFIQNTRFTPQMAKDILAGTLTLEDLVAQGICEFITPEEAENCLVAFSIIELRKHKHDVTRRFTHVDVPQAILGLAALVSPYANCTQPARVTYETNQGRQTGGWYCFSWPYRVDMNRFFQFYNEMPLVKTIAHNYVIPNGLNTIVAYMIYGGYNQEDSVIVSQSFIDRGGFAGTFYREEKVELESDIESFGKPDPLITKNLKPGANYEKLVDGFVPVGTVVKKGDIIIGKVAKIRGEKDELNKYIDRSVMYGFDEPAVVDAVMRPHGPNDEIFGLMRLRYERNLNIGDKMSSRSGNKGIAALALPTSDMPFTEDGLQPDLIVNPHSHPSRMTNGQMIETTVGLANALQGVVTDGTAFLPINVQLLSERLAQEGLRFNGCQKMFNGQTGEYFDAAIFIGPTYHQRLQKFVLDDRYAVASYGPTDALTGQPLDGKRSHGGLRLGEMEHWVLTAQGAMQTIIEKSHDDSDGCISYICRNCGEPAIYNASHPIYKCMNCDVQADIGMVDSRRSSIVFQHEMRAANVNITSVLSPRVFQPA

SEQ ID NO: 363 - protein, 21 aa, African swine fever virus
FLKQSGLQSFYLYIQPDHTCF

SEQ ID NO: 364 - protein, 152 aa, African swine fever virus; identical to SEQ ID NO: 139

SEQ ID NO: 365 - protein, 9 aa, African swine fever virus
KTYNHESNY

SEQ ID NO: 366 - protein, 158 aa, African swine fever virus
MFSNKKYIGLINKKEGLKKKIDDYSILIIGILIGTNILSLIINIIGEINKPICYQNDDKIFYCPKDWVGYNNVCYYFGNEEKNYNNASNYCKQLNSTLTNNNTILVNLTKTLNLTKTYNHESNYWVNYSLIKNESVLLRDSGYYKKQKHVSLLYICSK

SEQ ID NO: 367 - protein, 11 aa, African swine fever virus
SLFEGMIWKSY

SEQ ID NO: 368 - protein, 296 aa, African swine fever virus; identical to SEQ ID NO: 135

SEQ ID NO: 369 - protein, 10 aa, African swine fever virus
PAFPNPQKKI

SEQ ID NO: 370 - protein, 364 aa, African swine fever virus; identical to SEQ ID NO: 140

SEQ ID NO: 371 - protein, 369 aa, African swine fever virus; identical to SEQ ID NO: 141

SEQ ID NO: 372 - protein, 9 aa, African swine fever virus
YTNESILEY

SEQ ID NO: 373 - protein, 22 aa, African swine fever virus
CTYLTLSSNYFYTFFKLYYIPL

SEQ ID NO: 374 - protein, 11 aa, African swine fever virus
TYLTLSSNYFY

SEQ ID NO: 375 - protein, 11 aa, African swine fever virus
LTLSSNYFYTF

SEQ ID NO: 376 - protein, 11 aa, African swine fever virus
SNYFYTFFKLY

SEQ ID NO: 377 - protein, 9 aa, African swine fever virus
YQYNTPIYY

SEQ ID NO: 378 - protein, 360 aa, African swine fever virus
MIILIFLIFSNIVLSIDYWVSFNKTIILDSNITNDNNDINGVSWNFFNNSFNTLATCGKAGNFCECSNYSTSIYNITNNCSLTIFPHNDVFDTTYQVVWNQIINYTIKLLTPATPPNITYNCTNFLITCKKNNGTNTNIYLNINDTFVKYTNESILEYNWNNSNINNFTATCIINNTISTSNETTLINCTYLTLSSNYFYTFFKLYYIPLSIIIGITISILLISIITFLSLRKRKKHVEEIESPPPESNEEEQCQHDDTTSIHEPSPREPLLPKPYSRYQYNTPIYYMRPSTQPLNPFPLPKPCPPPKPCPPPKPCPPPKPCPSAESYSPPKPLPSIPLLPNIPPLSTQNISLIHVDRII

SEQ ID NO: 379 - protein, 10 aa, African swine fever virus
NKIKLLNEYL

SEQ ID NO: 380 - protein, 9 aa, African swine fever virus
YVLEKKHKL

SEQ ID NO: 381 - protein, 10 aa, African swine fever virus
NKIKLLNDYL

SEQ ID NO: 382 - protein, 9 aa, African swine fever virus
YVLEKKHKL

SEQ ID NO: 383 - protein, 10 aa, African swine fever virus
FISAINHFNY

SEQ ID NO: 384 - protein, 17 aa, African swine fever virus
AINHFNYTMMHYPTFNW

SEQ ID NO: 385 - protein, 9 aa, African swine fever virus
YTMMHYPTF

SEQ ID NO: 386 - protein, 11 aa, African swine fever virus
ATQRLTPIHLY

SEQ ID NO: 387 - protein, 9 aa, African swine fever virus
YTLNHAFTL

SEQ ID NO: 388 - protein, 424 aa, African swine fever virus
MSNYYYYYGGGRYDWLKTVEPTNFLKIGLPYQAHPLHLQHQATTTPPSILEKFKRADILLNEVKAEMDPLMLQPETEKKLYQILGSIDMFKGLRKKVEFTYNAQIVTNAWLKMYELLNTMNFNNTSQAFCNCELPGGFISAINHFNYTMMHYPTFNWVASSLYPSSETDALEDHYGLYQCNPDNWLMQSPLLKKNVDYNDGDVTIASNVKNLALRATQRLTPIHLYTADGGINVGHDYNKQEELNLKLHFGQALTGLLSLSKGGNMILKHYTLNHAFTLSLICVFSHFFEELYITKPTSSRPTNSETYIVGKNRLRLFTPKEEQILLKRLEFFNDTPLVDLSLYQNLLESIYFAVETIHLKQQIEFLNFGMKCYRHFYNKIKLLNEYLAPKKKIFQDRWRVLNKLYVLEKKHKLKLCAPQGSVA

SEQ ID NO: 389 - protein, 418 aa, African swine fever virus
MSNYYYYYGGGRYDWLKTVEPTNFLKIGLPYQAHPLHLQHQATTPPSILEKFKRADILLNEVKAEMDPLMLQPETEKKLFQILSSIDMFKGLRKKVEFTYNAQIVTNAWLKMYELLNTMNFNNTSQAFCNCELPGGFISAINHFNYTMMHYPTFNWVASSLYPSSETDALEDHYGLYQCNPDNWLMQSPLLKKNIDYNNGDVTIASNVKNLALRATQRLTPIHLYTADGGINVGHDYNKQEELNLKLHFGQALTGLLSLSKGGNMILKHYTLNHAFTLSLICVFSHFFEELYITKPTSSRPTNSETYIVGKNRLRLFTPKEEQVLLKRLEFFNDTPLVDLSLYQNLLESVYFAVETIHLKQQIEFLNFGMKCYRHFYNKIKLLNDYLAPKKKIFQDRWRVLNKLYVLEKKHKLKLCAS

SEQ ID NO: 390 - protein, 17 aa, African swine fever virus
NVIMDVFYETYSLPYNI

SEQ ID NO: 391 - protein, 10 aa, African swine fever virus
VIMDVFYETY

SEQ ID NO: 392 - protein, 10 aa, African swine fever virus
VFYETYSLPY

SEQ ID NO: 393 - protein, 9 aa, African swine fever virus
RTYNILQRF

SEQ ID NO: 394 - protein, 19 aa, African swine fever virus
LQFNYSFQSHMYAIMLLTK

SEQ ID NO: 395 - protein, 1048 aa, African swine fever virus
MQETFKFLRCNSQGEAVEDKYSLETLKNHFVVRDEYNNLFRVFSSRDDFWEWEAAQPFEQKCFHEVVFGFLPQRLKFDIDFPVNKSYSDDNVDDNDNVEDNVYDILDMIINVIMDVFYETYSLPYNINLTREQILLTDSIGLNKKRELKYSFHIILYTYSVLNNNEAKVFTSKVLENLPKHVYPFVDPQVNKSIQNFRIIGSHKKGSMRVKMFNEELAEVFETSTTTKKSDTLIATPFETTCLPCIFTNVKETTPSSCDTIQQSELEEVLKFAGTLCKNHCFLRVHKNLVLFKRTSPSYCEICKRMHDKDNTLILRVTGNKVYQHCRHDNKHSLLMGSLSGTNNFVETYVDQVMTKSIEVHESILFEELPDTQKHIYDESSMREYERVPTLVVKAQMKIGKTVQLRNYLQKYYGNNSISKQQTIRFVTFRQIFSKNIQSRLPNFTLYSEVTGDLDSYERVIIQVESLFRLTSTAEPVDLLILDEVESIFNQFNSGLHKYFAPSFAIFMWMLETANYVICLDANLGNRTYNILQRFRGDVPIFFHWNQYKRAQHDTYYFTSSRETWLNNLLKDLLEDKKIVIPTNSLMEARLLQSFIQKKFPEKKIGFYSSKSTAHERESHFNNVSYYWGLVDILIYTPTISAGVSYEDKRFDVLYGFFNNMSCDVETCCQMLGRVRELKSKCYKICLQGKQNYYPETIEDIEMFTLQKRDTLFQTISNHQLSFTYSKETGRPIYYKTPYYHLWLETMRIQHLSKNHFITRFINQIADTGAKVFILTGEKLETVKQYTSIKMEIKHQDYVNIASAETIDANKALQIKQNLKEGITVDQQDLFAYEKYKLLEFYAWHGHKITPKFVEQYNSFMTKQNYTGRVQISRGKTVYESLTMLQTQELNFHQWAMQHAEHHDLQFNYSFQSHMYAIMLLTKCGFKCVQDPNILTNEQLMTKLVDEFVQYDLSAISFEFKLKKPNKTDPQTILKFINKVLGLRYGLKIHHNKGNYYIKNTKAGSLIPFVRQQIKQSPCVVSNLLPITETSSAKEETSPIKEETFTET

SEQ ID NO: 396 - protein, 23 aa, African swine fever virus
KQASISSILNFFFFYIMEYFVAV

SEQ ID NO: 397 - protein, 10 aa, African swine fever virus
NFFFFYIMEY

SEQ ID NO: 398 - protein, 165 aa, African swine fever virus; identical to SEQ ID NO: 143

SEQ ID NO: 399 - protein, 10 aa, African swine fever virus
DFFIYEDERL

SEQ ID NO: 400 - protein, 13 aa, African swine fever virus
DFFIYEDERLLMF

SEQ ID NO: 401 - protein, 11 aa, African swine fever virus
SRRSLVNPWTL

SEQ ID NO: 402 - protein, 9 aa, African swine fever virus
RSLVNPWTL

SEQ ID NO: 403 - protein, 10 aa, African swine fever virus
TQMDKLGFLL

SEQ ID NO: 404 - protein, 317 aa, African swine fever virus; identical to SEQ ID NO: 144

SEQ ID NO: 405 - protein, 317 aa, African swine fever virus; identical to SEQ ID NO: 145

SEQ ID NO: 406 - protein, 9 aa, African swine fever virus
EFISRDEGM

SEQ ID NO: 407 - protein, 11 aa, African swine fever virus
FQYIRYFTDNL

SEQ ID NO: 408 - protein, 334 aa, African swine fever virus
MLIFISNMEELLIENSQRFTIFPIQHPECWNWYKKLESLTWTAQEVDMCKDIDDWEAMPKPQREFYKQILAFFVVADEIVIENLLTNFMREIKVKEVLYFYTMQAAQECVHSEAYSIQVKTLIPDEKEQQRIFSGIEKHPIIKKMAQWVRQWMDPDRNTLGERLVGFAAVEGILFQNHFVAIQFLKEQNIMPGLVSYNEFISRDEGMHCSFACFLISNYVYNIPEEKIIHKILKEAVELVDEFINYAFDKARGRVPGFSKEMLFQYIRYFTDNLCFMMQCKSIYKVGNPFPQMTKFFLNEVEKTNFFELRPTQYQNCVKDDAFAFKLFLNDDDF

SEQ ID NO: 409 - protein, 334 aa, African swine fever virus; identical to SEQ ID NO: 408

SEQ ID NO: 410 - protein, 11 aa, African swine fever virus
AMDEAIHAALY

SEQ ID NO: 411 - protein, 13 aa, African swine fever virus
FVSQSMSLNYYFY

SEQ ID NO: 412 - protein, 9 aa, African swine fever virus
VSQSMSLNY

SEQ ID NO: 413 - protein, 11 aa, African swine fever virus
SQSMSLNYYFY

SEQ ID NO: 414 - protein, 9 aa, African swine fever virus
SMSLNYYFY

SEQ ID NO: 415 - protein, 778 aa, African swine fever virus
METFFIETLASDVYGKALNVDLDRLSQAQVKYTLQELISYCSALTILHYDYSTLAARLSVYQLHQSTASSFSKAVRLQAAQSCSRLSPQFVDVVYKYKAIFDSYIDYSRDYKLSLLGIETMKNSYLLKNKDGVIMERPQDAYMRVAIMIYGMGRVVNMKMILLTYDLLSQHVITHASPTMFNAGTKKPQLSSCFLLNVNDNLENLYDMVKTAGIISGGGGGIGLCLSGIRAKNSFISGSGLKSNGIQNYIVLQNASQCYANQGGLRPGAYAVYLELWHQDIFTFLQMPRLKGQMAEQRLNAPNLKYGLWVPDLFMEILEDQIHNRGDGKWYLFSPDQAPNLHKVFDLERSQHENAHREFKKLYYQYVAEKRYTGVTTAKEIIKEWFKTVVQVGNPYIGFKDAINRKSNLSHVGTITNSNLCIEVTIPCWEGDKAEQGVCNLAAVNLAAFIRENGYDYRGLIEASGNVTENLDNIIDNGYYPTEATRRSNMRHRPIGIGVFGLADVFASLKMKFGSPEAIAMDEAIHAALYYGAMRRSIELAKEKGSHPSFPGSAASKGLLQPDLWVRCGDLVSSWEERVAQTTQGVLTPKRWSQLRLAAMQGLRNGYVTALMPTATSSNSTGKNECFEPFTSNLYTRRTLSGEFIVLNKYLIDDLKEINLWTEAIQQQLLNAGGSIQHILDIPAEIRDRYKTSREMNQKILTKHAAARNPFVSQSMSLNYYFYEPELSQVLTVLVLGWKKGLTTGSYYCHFSPGAGTQKKIIRNSEKACNADCEACLL

SEQ ID NO: 416 - protein, 11 aa, African swine fever virus
ENIAYERLETL

SEQ ID NO: 417 - protein, 10 aa, African swine fever virus
EPEPGERFSY

SEQ ID NO: 418 - protein, 10 aa, African swine fever virus
MPIDIHEVRY

SEQ ID NO: 419 - DNA, 33 bp, African swine fever virus
gaaaatattgcgtatgaacggctggagacgctc

SEQ ID NO: 420 - protein, 11 aa, African swine fever virus
ENIVYERLETL

SEQ ID NO: 421 - DNA, 33 bp, African swine fever virus
gaaaatattgtgtatgaacggctggagacgctc

SEQ ID NO: 422 - protein, 10 aa, African swine fever virus
MPIDIHEVRY

SEQ ID NO: 423 - protein, 11 aa, African swine fever virus
ENIVYERLETL

SEQ ID NO: 424 - protein, 8 aa, African swine fever virus
STQFMIQY

SEQ ID NO: 425 - protein, 12 aa, African swine fever virus
TAADDTTCYYRM

SEQ ID NO: 426 - protein, 9 aa, African swine fever virus
AADDTTCYY

SEQ ID NO: 427 - protein, 10 aa, African swine fever virus
IVMAYDIETY

SEQ ID NO: 428 - protein, 11 aa, African swine fever virus
ASLYPSLIMAY

SEQ ID NO: 429 - protein, 10 aa, African swine fever virus
SLYTEVTDAY

SEQ ID NO: 430 - protein, 1211 aa, African swine fever virus
MISIMDRSEIVARENPVITQRVTNLLQTNAPLLFMPIDIHEVRYGAYTLFMYGSLENGYKAEVRIENIPVFFDVQIEFNDTNQLFLKSLLTAENIAYERLETLTQRPVMGYREKEKEFAPYIRIFFKSLYERRKAITYLNNMGYNTAADDTTCYYRMVSRELKLPLTSWIQLQHYSYEPRGLVHRFSVTPEDLVSYQDDGPTDHSIVMAYDIETYSPVKGTVPDPNQANDVVFMICMRIFWIHSTEPLASTCITMAPCKKSSEWTTILCSSEKNLLLSFAEQFSRWAPDICTGFNDSRYDWPFIVEKSMQHGILEEIFNKMSLFWHQKLDTILKCYYVKEKRVKISAEKSIISSFLHTPGCLPIDVRNMCMQLYPKAEKTSLKAFLENCGLDSKVDLPYHLMWKYYETRDSEKMADVAYYCIIDAQRCQDLLVRHNVIPDRREVGILSYTSLYDCIYYAGGHKVCNMLIAYAIHDEYGRIACSTIARGKREHGKYPGAFVIDPVKGLEQDKPTTGLDFASLYPSLIMAYNFSPEKFVASRDEAKSLMAKGESLHYVSFHFNNRLVEGWFVRHNNVPDKMGLYPKVLIDLLNKRTALKQELKKLGEKKECIHESHPGFKELQFRHAMVDAKQKALKIFMNTFYGEAGNNLSPFFLLPLAGGVTSSGQYNLKLVYNFVINKGYGIKYGDTDSLYITCPDSLYTEVTDAYLNSQKTIKHYEQLCHEKVLLSMKAMSTLCAEVNEYLRQDNGTSYLRMAYEEVLFPVCFTGKKKYYGIAHVNTPNFNTKELFIRGIDIIKQGQTKLTKTIGTRIMEESMKLRRPEDHRPPLIEIVKTVLKDAVVNMKQWNFEDFIQTDAWRPDKDNKAVQIFMSRMHARREQLKKHGAAASQFAEPEPGERFSYVIVEKQVQFDIQGHRTDSSRKGDKMEYVSEAKAKNLPIDILFYINNYVLGLCARFINENEEFQPPDNVSNKDEYAQRRAKSYLQKFVQSIHPKDKSVIKQGIVHRQCYKYVHQEIKKKIGIFADLYKEFFNNTTNPIESFIQSARFMIQYSDGEQKVNHSMKKMVEQRATLASKPAGKPAGNPAGNPAGNALMRAIFTQLITEEKKIVQALYNKGDAIHDLLTYIINNINYKIATFQTKQMLTFEFSSTHVELLLKLNKTWLILAGIHVAKKHLQALLDSYNNEPPSRTFIQQAIEEECGSIKPSCYDFIS

SEQ ID NO: 431 - DNA, 3636 bp, African swine fever virus
atgatatctatcatggaccgttctgagattgttgcacgggagaacccggtgattacccaacgagttacaaatctcctacaaaccaatgctcctctactattcatgcccattgatatccatgaagtacgatatggagcctacacacttttcatgtatggttccctcgaaaacggttacaaagcagaagtaaggattgaaaacatcccagttttctttgacgtacagattgagttcaatgatacaaaccagctttttttaaagtcgctactgacggctgaaaatattgcgtatgaacggctggagacgctcacccagcgtcctgtaatggggtaccgcgagaaggaaaaagagtttgcaccatacattcgaatattttttaaaagcctgtatgagcgacgaaaagccattacttacttgaataatatgggttacaacaccgccgcggacgacacaacctgttactaccgaatggtttcccgagagctaaaactgcctcttacaagttggatacagcttcagcactattcctacgagcctcgcggcttggtacacaggttttccgtaacccccgaggatcttgtttcctatcaggatgatggccccacagaccacagcatcgttatggcctacgatatagagacctatagccctgttaagggaaccgttccggacccaaatcaggcaaacgacgtggtgttcatgatatgcatgcgcattttttggattcactccacagagcctctagcgagcacgtgcatcactatggcaccctgcaaaaagtcctcagagtggaccaccattctatgctcctctgaaaaaaatttgctgttaagctttgctgaacagttcagccgctgggctcctgatatatgcacagggttcaatgattctcggtacgactggccctttatcgttgaaaaatctatgcagcacggtattctagaagaaatctttaacaaaatgagccttttctggcaccaaaagctggataccattctaaaatgctattatgtgaaggaaaagagagtcaaaatctcggccgaaaaatcgatcatttcctcctttttgcatacccctggatgcctacccattgatgtccgcaacatgtgtatgcagctttaccctaaagccgaaaaaacaagcctaaaagcgtttttagaaaattgtgggttagattcgaaggtagacctgccctaccatctcatgtggaagtattatgaaacgcgagacagtgaaaagatggccgacgtggcctactactgcattatagatgcccagcgctgtcaggaccttctggtgcgccacaatgttatccccgatcgcagagaggtaggaatcttgtcatacacctcgttgtatgactgtatctactacgcgggaggacataaggtatgtaatatgctcattgcctatgctatccatgatgagtacggccgtattgcttgcagcaccattgctcggggtaagcgggaacacggaaaatatccgggcgcctttgtgattgaccccgttaaagggcttgaacaggataaacccaccaccggcctcgattttgcgtcgctgtacccctcactcatcatggcctacaacttttcgccagaaaaatttgtagcctctcgggatgaggcaaaaagcctcatggccaagggtgaatctcttcactacgtctcctttcactttaacaatcgtctcgtggaaggatggtttgtgcgacataataacgttcctgataaaatgggattatacccaaaagtactcatcgatctacttaacaaacgaaccgcccttaaacaagagcttaaaaaactaggtgagaaaaaagaatgtatccatgaatcccatcctgggtttaaggaactacagtttcgccatgccatggtagacgcgaagcaaaaggcgttgaaaattttcatgaacacgttttacggcgaggcaggtaacaatttgtcgcccttctttctgcttcctctagccggaggagtcaccagttcgggtcaatataatcttaaactcgtctataactttgttatcaataaaggttacggcatcaagtacggtgacaccgactcattatacattacatgcccagatagtctttatacagaggtaacagacgcatatttaaatagccaaaaaacaataaaacattatgagcaactctgccacgaaaaagtgcttctgtctatgaaagccatgtctacactatgcgccgaggtgaatgaatacctgcggcaagataatggcaccagttacctacgtatggcctacgaggaagtactctttcctgtgtgctttacaggcaagaaaaagtattacggtattgctcatgtaaacacacccaattttaatacaaaagaattattcatccgcggaatagatatcattaagcagggtcaaacaaaactcaccaaaacgataggtacgcgaattatggaagaatccatgaaactgcgccgccctgaggaccatcgcccccctcttattgaaatcgttaaaacggttttgaaggatgctgtggttaacatgaagcagtggaattttgaagacttcatccaaacagatgcgtggagaccggacaaagacaacaaagcagtccaaatctttatgtctcgcatgcacgctcggcgtgagcaactaaaaaaacacggcgccgcagcatcgcaatttgctgagcctgagccgggagaacgcttctcctacgttatcgtggaaaaacaagtacagtttgatattcagggccaccgcacagattcctccagaaagggggacaagatggaatacgtctctgaagcaaaggctaaaaatcttccaattgatatattgttttatatcaacaactatgttctaggcttgtgcgcgagattcattaatgaaaatgaagaatttcaaccccctgacaatgtcagcaataaggatgaatacgctcagcgccgagccaaatcctacctacaaaaattcgtacaatccattcaccctaaagacaagtctgtcattaagcaaggcattgttcatcgacagtgctacaaatacgttcaccaagaaattaaaaaaaaaataggcatctttgccgacctttataaggaattttttaacaacaccacaaaccccatcgaaagctttattcaaagcgctcggtttatgatacaatactctgatggagaacaaaaagtaaaccattctatgaaaaaaatggttgaacagcgtgctactttggcaagtaagcccgctggtaagcccgctggtaatccagctggcaacccagccggcaatgcgctgatgcgggctatatttacgcagctgattacggaagaaaaaaaaattgtacaagccttatacaataagggggatgcaatacacgatcttctcacctatatcattaacaatataaattacaaaattgccacgtttcagacgaaacagatgttgacgttcgagttttctagtactcatgtagaactgctattaaagctgaataagacgtggcttattttggctggaattcatgtggcgaaaaaacatctgcaagctcttttggattcatataataatgaaccaccgtctagaacattcattcagcaggctatagaggaagaatgtggcagtattaaaccatcttgctacgactttatttcctaa

SEQ ID NO: 432 - protein, 1206 aa, African swine fever virus
MISIMDRSEIVARENPVITQRVTNLLQTNAPLLFMPIDIHEVRYGAYTLFMYGSLENGYKAEVRIENIPVFFDVQIEFNDTNQLFLKSLLTAENIVYERLETLTQRPVMGYREKEKEFAPYIRIFFKSLYERRKAITYLNNMGYNTAADDTTCYYRMVSRELKLPLTSWIQLQHYSYEPRGLVHRFSVTPEDLVSYQNDGPTDHSIVMAYDIETYSPVKGTVPDPNQANDVVFMICMRIFWIHSTEPLASTCITMAPCKKSSEWTTILCSSEKNLLLSFAEQFSRWAPDICTGFNDSRYDWPFIVEKSMQHGILEEIFNKMSLFWHQKLDTILKCYYVKEKRVKISAEKSIISSFLHTPGCLPIDVRNMCMQLYPKAEKTSLKAFLENCGLDSKVDLPYHLMWKYYETRDSEKIADVAYYCIIDAQRCQDLLVRHNVIPDRREVGILSYTSLYDCIYYAGGHKVCNMLIAYAIHDEYGRIACSTIARGKREHGKYPGAFVIDPVKGLEQDKPTTGLDFASLYPSLIMAYNFSPEKFVASRDEANSLMAKGESLHYVSFHFNNRLVEGWFVRHNNVPDKMGLYPKVLIDLLNKRTALKQELKKLGEKKECIHESHPGFKELQFRHAMVDAKQKALKIFMNTFYGEAGNNLSPFFLLPLAGGVTSSGQYNLKLVYNFVINKGYGIKYGDTDSLYITCPDSLYTEVTDAYLNSQKTIKHYEQLCHEKVLLSMKAMSTLCAEVNEYLRQDNGTSYLRMAYEEVLFPVCFTGKKKYYGIAHVNTPNFNTKELFIRGIDIIKQGQTKLTKTIGTRIMEESMKLRRPEDHRPPLIEIVKTVLKDAVVNMKQWNFEDFIQTDAWRPDKDNKAVQIFMSRMHARREQLKKHGAAASQFAEPEPGERFSYVIVEKQVQFDIQGHRTDSSRKGDKMEYVSEAKAKNLPIDILFYINNYVLGLCARFINENEEFQPPDNVSNKDEYAQRRAKSYLQKFVQSIHPKDKSVIKQGNVHRQCYKYIHQEIKKKIGIFADLYKEFFNNTTNPIESFIQSTQFMIQYFDGEQKVNHSMKKMVEQHATASNRAGKPAGNPAGNALMRAIFTQLITEEKKIVQALYNKGDAIHDLLTYIINNINYKIATFQTKQMLTFEFSSTHVELLLKLNKTWLILAGIHVAKKHLQAFLDSYNNESPSRTFIQQAIEEECGSIKPSCYDFIS

SEQ ID NO: 433 - DNA, 3621 bp, African swine fever virus
atgatatctatcatggaccgttctgagattgttgcacgggagaacccggtgattacccaacgagttacaaatctcctacaaaccaatgctcctctactattcatgcccattgatatccatgaagtacgatatggagcctacacacttttcatgtatggttccctcgaaaacggttacaaagcagaagtaaggattgaaaacatcccagttttctttgacgtacagattgagttcaatgatacaaaccagctttttttaaagtcgctactgacggctgaaaatattgtgtatgaacggctggagacgctcacccagcgtcctgtaatggggtaccgcgagaaggaaaaagagtttgcaccatacattcgaatattttttaaaagcctgtatgagcgacgaaaagccattacttacttaaataatatgggctacaacacggccgcggacgacacaacctgttattaccgaatggtttcccgagaattaaaactacctcttacaagttggatacagcttcagcactattcctacgagcctcgcggcttggtacacaggttttccgtaacccccgaggatcttgtttcctatcagaatgatggccccacagaccacagcatcgttatggcctacgatatagagacctatagccctgttaagggaaccgttccggacccaaatcaggcaaacgacgtggtgttcatgatatgcatgcgcattttttggattcactccacagagcctctagcgagcacgtgcatcaccatggcaccctgcaaaaagtcctcagagtggaccaccattctatgctcctctgaaaaaaatttgttgttaagctttgctgaacagtttagccgctgggctcctgatatatgcacagggttcaatgattctcggtacgactggccctttatcgttgaaaaatctatgcagcacggtattctagaagaaatctttaacaaaatgagccttttctggcaccaaaagctggataccattctaaaatgctattacgtaaaggaaaagagagtcaaaatctcggccgaaaaatcgatcatttcctcctttttgcatacccctggatgcctacccattgatgtccgcaacatgtgtatgcagctttaccctaaagccgaaaaaacaagcttgaaagcgtttttagaaaattgtgggttagattcgaaggtagacctgccgtaccatctcatgtggaagtattatgaaacacgagacagcgaaaaaatagccgacgtggcctattactgcattatagatgcccagcgctgtcaggaccttctggtgcgccacaatgttatccccgatcgcagagaggtaggaattctgtcatacacctcgctgtatgactgtatctactacgcgggaggacacaaggtatgcaatatgctcattgcctatgccatccatgatgaatacggccgtattgcttgcagtaccattgcccgaggtaagcgggaacacggaaaatatcccggcgcctttgtgatagaccccgttaaagggcttgaacaggataaacccaccacaggtctcgactttgcgtcgctgtacccctcactcatcatggcctacaacttttcgccagaaaaatttgtagcctctcgggatgaggcaaatagcctcatggccaagggtgaatctcttcactacgtctcctttcactttaacaatcgtctcgtggaaggatggtttgtgcggcataataacgttcctgataaaatgggattgtacccaaaagtactcatcgatctacttaacaaacggaccgcccttaaacaagagcttaaaaaactaggtgagaaaaaagaatgtatccatgaatcccatcctgggtttaaggaactacagtttcgccatgccatggtagacgcgaagcaaaaggcgttgaaaattttcatgaacacgttttacggcgaggcaggtaacaatttgtcgcccttctttctgcttcctctagccggaggagtcaccagttcgggtcaatataatcttaaacttgtctataactttgttatcaataaaggttacggcatcaagtacggtgacaccgactcattatacattacatgcccagatagtctttatacagaggtaacagacgcatatttaaacagccaaaaaacgataaaacattatgagcaactctgccacgaaaaagtgcttctgtctatgaaagccatgtctacactatgcgccgaggtgaatgaatacctgcgacaagataatggcaccagttacctacgtatggcctacgaggaagtactctttcctgtgtgctttacaggcaagaaaaagtattatggtattgctcatgtaaacacacccaattttaatacaaaagaattattcatccgcggaatagatatcattaagcagggtcaaacaaaactcaccaaaacgataggaacgcgaattatggaagaatccatgaaactacgccgccctgaggaccatcgcccccctcttattgaaatcgttaaaacggttttgaaggatgctgtggttaacatgaagcagtggaattttgaagacttcatccaaacagatgcgtggagaccggacaaagacaacaaagcagtccaaatctttatgtctcgcatgcacgctcggcgtgagcaactaaaaaaacacggcgctgcagcatcgcaatttgctgagcccgagccgggagaacgcttctcctacgttatcgtggaaaaacaggtacagtttgatatccagggccaccgcacagattcctccagaaagggggacaagatggaatacgtctctgaagcaaaggctaaaaatcttcctattgatatattgttttatatcaacaactatgttctaggcttgtgcgcgagattcattaatgaaaatgaagaatttcaaccccctgacaacgtcagcaataaggatgaatacgctcagcgccgagctaaatcctacctacaaaaattcgtgcaatccattcaccctaaagacaagtctgtcattaagcaaggcaatgttcatcgacagtgctacaaatacattcaccaagaaattaaaaaaaaaataggcatctttgccgacctttataaggaattttttaacaacaccacaaaccccatcgaaagctttattcaaagcactcagtttatgatacaatactttgatggagaacaaaaagtaaaccattctatgaaaaaaatggttgaacagcatgctacggctagtaatcgagctggtaagcccgctggtaatccagccggcaatgcgctgatgcgggctatatttacgcagctgattacggaagaaaaaaaaattgtacaagccttatacaataagggggatgcaatacacgatcttctcacctatatcattaacaatataaattacaaaattgccacgtttcagacgaaacagatgttgacgttcgagttttccagtactcatgtagaactgctattaaagctgaataaaacgtggcttattttggctggaattcatgtggcaaaaaaacatctgcaagcttttttggattcatataacaatgaatcgccgtctagaacattcattcagcaggctatagaggaagaatgtggcagtattaaaccatcttgctacgactttatttcctaa

SEQ ID NO: 434 - protein, 11 aa, African swine fever virus
DFVDLNDIHTI

SEQ ID NO: 435 - protein, 8 aa, African swine fever virus
YQFDLLYY

SEQ ID NO: 436 - protein, 21 aa, African swine fever virus
IQISISSMSVSTFWPYTLSSK

SEQ ID NO: 437 - protein, 11 aa, African swine fever virus
MSVSTFWPYTL

SEQ ID NO: 438 - protein, 8 aa, African swine fever virus
STFWPYTL

SEQ ID NO: 439 - protein, 17 aa, African swine fever virus
KMDINVALLQNTYAYLF

SEQ ID NO: 440 - protein, 9 aa, African swine fever virus
NVALLQNTY

SEQ ID NO: 441 - protein, 9 aa, African swine fever virus
ALLQNTYAY

SEQ ID NO: 442 - protein, 10 aa, African swine fever virus
VMMPEIETMY

SEQ ID NO: 443 - protein, 1340 aa, African swine fever virus
MDFQNDFLTNPLRVTLYNPAENEYTKTFIFLGSVPANVLQACRKDLQRTPKDKEILQNFYGKDWEKKLSQYVVGGDSDDLDEFEKLFVEDSGEETNVMMPEIETMYSEYSIFPEDTFKDIREKIYVATGIPPYRQHIFFFQNNALQVTYRLLLSGSGVALDIRDYKKEFQQVGGLNIDASMESQKDELYVEALDSFQLIKNIHHIFVADLNTLVAPMRRQISIAMEDNYQFDLLYYGLIMKYWPLLSPDAFKLLVQSPLQMEKQYPALSPSLTSLKKRLLLEQKLINFTYARAQQVIAKYEGNRLTRGTLAVTSAMIKISPLVNIQINVRNVFDLFPATPDIPQLVVFFYSKTGPTVVSKHHITSTEPEKFSNKTFRVPTIILIRFINKKAFILTIQNNGHYFIESNWSENERHDFNSVVSTLNNFINPIIHTINDMGPAAFPRGGSLPLPSNEDIQISISSMSVSTFWPYTLSSKGFTELKSRWREYEQAGIISVRGLQQTGIYNFLFKKGIYSYDPHEIERMIIISSGPGRKMDINVALLQNTYAYLFDANVAARWETIYGGRNIRIYHRVTDIKIEMFNITQEEFNYLWVYLFVFLDNLITGPDKILVNKLSQLHDKQQGKGASQLRALQEQDPDLYDLRKYDTQATVYSVLCQHPRPPVIYSEAEVKSMPPAKRKELVKYWNFTEGVPAYYSCPHPDYPHLSLLEGRHPLNYCLPCCQKTKALLGTKRFYINNTCLTKHTFVEQDLEDLNTQTSRHTLSYGKKIPVNRIAFLPHQIADELFLNTIKEPDIFCIVGVEQTMLGISNAGLFYSLARILDLAPKALAIEIAKAANTPQYYILGNGAGNMFSSGAELANLILQTFVEQKNQLLQWDTTWQDIFLDLVAICYDLHCVFFKDKQGDIEFEVSPSTIQKILSPSKKIAIIFDTDEGIYPMAITQQKRFLKNSEAQYIFTEDDPVMEVVQSMSEFMCKDNWWDIHDVKNIPGYTVGKKLINRHNFCYALLIDSDTDRPIYFPIRLSSYIHDDIPIDFDLRPTQIASFEETWKFITLFNKQYKQYEIVPSAVLQNIKKEFVGFLSEGKTGLYFYYAPTQTLPATLEKLPIATLTIDPRDIDQAILYPLEEPYPQQNKANKAFYINHLYKFLLIEFFDVLYGLQSNSTRKHIENLFQKTDFQKITSVTEFYTKLSDFVDLNDIHTIKHILETTDAEHALKVLQKNIFNFDYTLLSPLQSYTYDELCQHLKKLLTPRIEFYEDIETIDRGLINIYTSCQYSTLNQPQCKKKRLRIPVNHFENYIHILAADILNPLKHSTLLLTGLGVIDDLQFILRPQEIISVKNKF

SEQ ID NO: 444 - protein, 1340 aa, African swine fever virus
MDFQNDFLTNPLRVTLYNPVENEYTKTFIFLGSVPANVLQACRKDLQRTPKDKEILQNFYGEDWEKKLSQYVVGGDSDDLDEFEKLFVEDRGEETNVMMPEIETMYSEYSIFPEDTFKDIREKIYVATGIPPYRQHIFFFQNNALQVTYRLLLSGSGVALDIRDYKKEFQQVGGVNIDASMESQKDELYVEALDSFQLIKNIHHIFVADLNTLVAPMRRQISIAIEDNYQFDLLYYGLIMKYWPLLSPDAFKLLVQSPLQMEKQYPALSPSLTSLKKRLLLEQKLINFTYARAQQVIAKYEGNRLTRGTLAVTSAMIKISPLVNIQINVRNVFDLFPATPDIPQLVVFFYSKTGPTVVSKHHITSTEPEKFSNKTFRVPTIILIRFINKKAFILTIQNNGHYFIESNWSENERHDFNSVVSTLNNFINPIIHTINDMGPAAFPRGGSLPLPSNEDIQISISSMSVSTFWPYTLSSKGFTELKSRWREYEQAGIISVRGLQQTGVYNFLFKKGIYSYDPHEIERMIIISSGPGRKMDINVALLQNTYAYLFDTNVAARWETIYGGRNIRIYHRVTDIKIEMFNITQEEFNYLWVYLFVFLDNLITGPDKILVNKLSQLHDKQQGKGASQLRALQEQDPDLYDLRKYDTQATVYSVLCQHPRPPVIYSEAEVKSMPPAKRKELVKYWNFTEGVPAYYSCPHPDYPHLSLLEGRHPLNYCLPCCQKTKALLGTKRFYINNTCLTKHTFVEQDLEDLNTQTSRHTLSYGKKIPVNRIAFLPHQIADELFLNTIKEPDIFCIVGVEQTMLGISNAGLFYSLARILDLAPKALAIEIAKAANTPQYYILGNGAGNMFSSGAELANLILQTFVEQKNQLLQWDTTWQDIFLDLVAICYDLHCVFFKDKQGDIGFEVSPSTIQKILSPSKKIAIIFDTDEGIYPMAITQQKRFLKNSEAQYIFTEDDPVMEVIQSMSEFMCKDNWWDIHDVKNIPGYTVGKKLINRHNFCYALLIDSDTDRPIYFPIRLSSYIHDDIPIDFDLRPTQIASFEETWKFITLFNKQYKQYEIVPSAVLQNIKKEFVGFLSEGKTGLYFYYAPTQTLPATLEKLPIATLTIDPRDIDQAILYPLEEPYPQQNKANKAFYINHLYKFLLIEFFDVLYGLQSNSTRKHIENLFQKTDFQKITSVTEFYTKLSDFVDLNDIHTIKHILETTDAEHALKVLQKNIFNFDYTLLSPLQSYTYDELCQHLKKLLTPRIEFYEDIETIDRGLINIYTSCQYSTLNQPQCKKKRLRIPVNHFENYIHILAADILNPLKHSTLLLTGLGVIDDLQFILRPQEIISVKNKF

SEQ ID NO: 445 - protein, 11 aa, African swine fever virus
MSMIGPYLNVY

SEQ ID NO: 446 - protein, 10 aa, African swine fever virus
SMIGPYLNVY

SEQ ID NO: 447 - protein, 124 aa, African swine fever virus; identical to SEQ ID NO: 146

SEQ ID NO: 448 - protein, 9 aa, African swine fever virus
NAYAHKLNI

SEQ ID NO: 449 - protein, 10 aa, African swine fever virus
SPFSLAHLEY

SEQ ID NO: 450 - protein, 233 aa, African swine fever virus
MILIASPFSLAHLEYLHTWHVTIKNIAQQHGLDIKVAIVVSTSHLNNFLPISGALNIECITFPSCGIKEIDLLWARIKLFQHYCAIGARLLWLVSADIRPPVSAWPAIADSLKKGADAVVIPYPSRWNNLIPTVIKEIVVHQKKCLVAVDARHLDTDTQIVGAGMGCIVLTLKALMVRLSIGKQPVKILWPDLHGTAEGIPLEGVEVGWFLNAYAHKLNIRCLGADHIAQHLT

SEQ ID NO: 451 - protein, 233 aa, African swine fever virus; identical to SEQ ID NO: 450

SEQ ID NO: 452 - protein, 10 aa, African swine fever virus
VVQYLTPIFY

SEQ ID NO: 453 - protein, 241 aa, African swine fever virus
MAANIIATRAVPKMASKKEHQYCLLDSQEKRHGHYPFSFELKPYGQTGANIIGVQGSLTHVIKMTVFPFMIPFPLQKTHIDDFIGGRIYLFFKELDMQAVSDVNGMQYHFEFKVVPVSPNQVELLPVNNKYKFTYAIPVVQYLTPIFYDLSGPLDFPLDTLSVHVDILSNHIQLPIQNHNLTTGDRVFISGYKHLQTIELCKNNKIFIKNIPPLSSEKIKLYILKNRIRIPLYFKSLKTSK

SEQ ID NO: 454 - protein, 9 aa, African swine fever virus
DSKNISPRI

SEQ ID NO: 455 - protein, 10 aa, African swine fever virus
NKIESSVHLL

SEQ ID NO: 456 - protein, 9 aa, African swine fever virus
NPTIIMEQY

SEQ ID NO: 457 - DNA, 27 bp, African swine fever virus
aacccaaccatcattatggaacagtac

SEQ ID NO: 458 - protein, 9 aa, African swine fever virus
NPTIIMEQY

SEQ ID NO: 459 - DNA, 27 bp, African swine fever virus
aacccaaccatcattatggaacagtac

SEQ ID NO: 460 - protein, 10 aa, African swine fever virus
NKIESSVHLL

SEQ ID NO: 461 - protein, 9 aa, African swine fever virus
NPTIIMEQY

SEQ ID NO: 462 - protein, 9 aa, African swine fever virus
DSKNISPRI

SEQ ID NO: 463 - protein, 10 aa, African swine fever virus
KLYTAALGVY

SEQ ID NO: 464 - protein, 9 aa, African swine fever virus
KLWAAYEGY

SEQ ID NO: 465 - protein, 9 aa, African swine fever virus
AAYEGYFKY

SEQ ID NO: 466 - protein, 339 aa, African swine fever virus
MAGRVKIKQKELIDSTVKNKNVMNLFHEIIGSKGNINFSVVWPKFKKIKQSVYDYISTLSVLEKASVMQNFEADKKLLELFVQKLWAAYEGYFKYPEIEKYEVEGQVNFNLVPQCVLEKFSQLYRIRINSELVTLILNSCAFMSKYNDYILKKDPYILTITPGLCFSPIPNFEDLNFKHLYNSDKNSQHDKEFIMFILYKLYTAALGVYNAISIPDIDVEDLENIILSSVSQIKKQIPRCKDAFNKIESSVHLLRKNFNTYYSDYVGSGYNPTIIMEQYIKDISQDSKNISPRISYQFRTIIKYYRDMIATRHQTMDPQVLNLVKHVEKKLDMLDREKN

SEQ ID NO: 467 - DNA, 1020 bp, African swine fever virus
atggccggtcgtgttaaaataaaacagaaagagctcatagactctactgtaaaaaacaaaaatgtgatgaatctgttccatgaaattataggctcaaaaggcaatattaattttagcgttgtctggcccaagtttaaaaaaatcaaacagagcgtttatgactacatttccactctttctgtgctggaaaaagcaagcgttatgcaaaactttgaagctgataagaaactgttggaactttttgtacaaaagctgtgggctgcctatgaaggctatttcaaatatcccgagattgaaaaatatgaggtggaaggccaggtaaatttcaatctcgtacctcagtgcgtcctcgaaaagtttagccagttgtataggataagaatcaattcagagcttgtcacactcatcctgaacagctgtgcctttatgagtaaatataacgattatattctcaaaaaagatccctacatactaaccataacccccggcctatgcttttcccccattcccaacttcgaggacctaaattttaaacatctttacaacagtgataaaaattctcagcatgacaaagagtttatcatgtttatattatataagctttatacggctgccctaggagtgtacaatgccatctcgattccagacatcgacgtagaagaccttgaaaatattatcctatcctcggtgagccagattaaaaaacaaattccgcgctgcaaagacgccttcaacaaaattgaatcttcggtacacctgctgcgcaaaaattttaacacatattacagtgactatgtgggctcaggctacaacccaaccatcattatggaacagtacattaaagacatatcacaggattccaagaacatatcaccacgcatttcctaccagtttagaaccatcatcaagtattaccgcgacatgatcgccaccaggcatcaaacgatggacccccaggtattaaacctcgtaaagcacgtcgaaaagaaattagatatgcttgatagagaaaaaaattag

SEQ ID NO: 468 - protein, 339 aa, African swine fever virus
MAGRVKIKQKELIDSTVKNKNVMNLFHEIIGSKGNINFSVVWPKFKKIKQSVYDYISTLSVLEKANVMQNFEADKKLLELFVQKLWAAYEGYFKYPEIEKYEVEGQVNFNLVPQCVLEKFSQLYRIRINSELVTLILNSCAFMSKYNDYILKKDPYILTITPGLCFSPIPNFEDLNFKHLYNSDKNSQHDKEFIMFILYKLYTAALGVYNAISIPDIDVEDLENIILSSVSQIKKQIPRCKDAFNKIESSVHLLRKNFNTYYSDYVGSGYNPTIIMEQYIKDISQDSKNISPRISYQFRTIIKYYRDMIATRHQTMDPQVLNLVKHVEKKLDMLDREKN

SEQ ID NO: 469 - DNA, 1020 bp, African swine fever virus
atggccggtcgtgttaaaataaaacagaaagagctcatagactctactgtaaaaaacaaaaatgtgatgaatctgttccatgaaattataggctcaaaaggcaatattaattttagcgttgtctggcccaagtttaaaaaaatcaaacagagcgtttatgactacatttccactctttctgtgctggaaaaagcaaacgttatgcaaaactttgaagctgataagaaactgttggaactttttgtacaaaagctgtgggctgcctatgaaggctatttcaaatatcccgagattgaaaaatatgaggtggaaggccaggtaaatttcaatctcgtacctcagtgcgtcctcgaaaagtttagccagttgtataggataagaatcaattcagagcttgtcacactcatcctaaacagctgtgcctttatgagtaaatataacgattatattctcaaaaaagatccctacatactaaccataacccccggcctatgcttttcccccattcccaacttcgaggacctaaattttaaacatctttacaacagtgataaaaattctcagcatgacaaagagtttatcatgtttatattatataagctttatacggctgccctaggagtgtacaatgccatctcgattccagacatcgacgtagaagaccttgaaaatatcatcctatcctcggtgagccagattaaaaaacaaattccgcgctgcaaagacgccttcaacaaaattgaatcttcggtacacctgttgcgcaaaaattttaacacatattacagtgactatgtgggctcaggctacaacccaaccatcattatggaacagtacattaaagacatatcacaggattccaagaacatatcaccacgcatttcctaccagtttagaaccatcatcaagtattaccgcgacatgattgccaccaggcatcaaacgatggacccccaggtattaaacctcgtaaagcacgtcgaaaagaaattagatatgcttgatagagaaaaaaattag

SEQ ID NO: 470 - protein, 9 aa, African swine fever virus
FNLAVKTHF

SEQ ID NO: 471 - protein, 359 aa, African swine fever virus; identical to SEQ ID NO: 150

SEQ ID NO: 472 - protein, 359 aa, African swine fever virus; identical to SEQ ID NO: 151

SEQ ID NO: 473 - protein, 11 aa, African swine fever virus
VSLGGTGECYY

SEQ ID NO: 474 - protein, 170 aa, African swine fever virus
MFYPAIQVLIGIILVIILILGFYHIKHKLPKKKCKTDTDCKDKGHHCVRGTCTDKSCLEAVKQDIKDIKLDPTIRSCDYTPGFYRFNATTADLQSPFGKTRIDLGKIWTSWGREADYCQSLCLQHKGCIGWEFDEMSLGGEGKCYCYTNPHPALKNSNNTTVMEIARNVL

SEQ ID NO: 475 - protein, 170 aa, African swine fever virus
MFYPVVQVLIGIILVIILILGFYHLKHKPPKKKCKTDTDCKDKGHHCVRGTCTDKSCLEAVKQDIKDIKLDPTIRSCDYAPGFYRFNATTADLQSPFGKTRIDLGRIWTTWSKEDECCQSLCLQHKGCIGWEFDEVSLGGTGECYYYLNPHLALKNSNNNTVMGIARNVL

SEQ ID NO: 476 - protein, 10 aa, African swine fever virus
MVSRFLIAEY

SEQ ID NO: 477 - protein, 212 aa, African swine fever virus; identical to SEQ ID NO: 157

SEQ ID NO: 478 - protein, 9 aa, African swine fever virus
KNILNTLMF

SEQ ID NO: 479 - protein, 9 aa, African swine fever virus
TNLYLKQEL

SEQ ID NO: 480 - DNA, 27 bp, African swine fever virus
aaaaacattttaaatacgttgatgttt

SEQ ID NO: 481 - protein, 9 aa, African swine fever virus
KNILNTLMF

SEQ ID NO: 482 - DNA, 27 bp, African swine fever virus
aaaaacattttaaatacgttgatgttt

SEQ ID NO: 483 - protein, 9 aa, African swine fever virus
TNLYLKQEL

SEQ ID NO: 484 - protein, 8 aa, African swine fever virus
KNILNTLM

SEQ ID NO: 485 - protein, 8 aa, African swine fever virus
TLMFAVRY

SEQ ID NO: 486 - protein, 8 aa, African swine fever virus
RQLSFVLL

SEQ ID NO: 487 - protein, 226 aa, African swine fever virus
MKMETFLVCLFHNADGLHQQIQEILYLLRMHIYETNLYLKQELSRLIYPNRQLSFVLLMPLSLLRNWDDIEYLTDVVDDKQTLHYAANLLTNYVLHLSMFQKLTKPYFLLAVKRVSEKLNKRQRHSFYEVLVTSETLNNYENLSKNILNTLMFAVRYVFKPTPNYSEILAELEKKNKIHHIIFNMVIADFAQIRKQQMDKHLCETNNELRQECKETIFDLKVVGNV

SEQ ID NO: 488 - DNA, 681 bp, African swine fever virus
atgaaaatggaaacatttttagtctgtttatttcacaatgctgatggtttacatcaacagattcaggaaattttgtatttattgcggatgcatatttatgagacaaatctttacttaaagcaggaactatcacggcttatatatccaaataggcagctttcttttgtgttacttatgcccctttcccttctaagaaactgggatgacattgaatatttgacggacgttgtagacgataagcagactctacattacgcggcaaatttgctgacaaactacgttctacatctatccatgtttcaaaagctgacaaaaccatacttccttttagcggtaaagcgggtcagcgaaaaactcaacaaaaggcagcgacattcattttacgaggtattggtaacctctgaaaccttgaataattatgaaaacctatctaaaaacattttaaatacgttgatgtttgccgtgcgctacgtatttaaacctacaccgaactattcagaaattctcgcagagttggaaaaaaaaaataaaattcaccatattatttttaatatggtaattgcggattttgcgcaaatccgtaaacaacaaatggataaacatctgtgcgaaacaaataatgagcttcgtcaggaatgtaaagaaactatttttgatttaaaggtggtaggaaatgtttag

SEQ ID NO: 489 - protein, 226 aa, African swine fever virus
MKMETFLVCLFHNADGLHQQIQEILYLLRMHIYETNLYLKQELSRLIYPNRQLSFVLLMPLSLLRNWDDIEYLTDVVDDKQTLHYAANLLTNYVLHLSMFQKLTKPYFLLAVKRVSEKLNKKQRHSFYEVLVTSETLNNYENLSKNILNTLMFAVRYVFKPTPNYSEILAELEKKNKIHHIIFNMVITDFAQIREQQMDKHLCETNNELRQECKETIFDLKVVGNV

SEQ ID NO: 490 - DNA, 681 bp, African swine fever virus
atgaaaatggaaacatttttagtctgtttatttcacaatgcagatggtttacatcaacagattcaggaaattttgtatttattgcggatgcatatttacgaaacaaatctttacttaaagcaggaactatcacggcttatatatccaaataggcaactttcttttgtgttacttatgcccctttcccttctaagaaactgggatgacattgaatatttaacggacgttgtagatgataagcagactctacattacgcggcaaatttgctgacaaactacgttctacatctatccatgtttcaaaagctgacaaaaccatacttccttttagcggtcaagcgggtcagcgaaaaactcaacaaaaagcagcgacattcattttacgaggtattggtaacctccgaaaccttgaataattatgaaaacctatctaaaaacattttaaatacgttgatgtttgccgtgcgctacgtatttaaacctacgccgaactattcagaaattctcgcagagttggaaaaaaaaaataaaattcaccatattatttttaatatggtaattacggattttgcgcaaatccgtgaacaacaaatggataaacatctgtgtgaaacaaataatgagcttcgtcaggaatgtaaagaaactatttttgatttaaaggtggtaggaaatgtttag

SEQ ID NO: 491 - protein, 8 aa, African swine fever virus
NTILTNKI

SEQ ID NO: 492 - protein, 9 aa, African swine fever virus
IQMMFFRTL

SEQ ID NO: 493 - protein, 243 aa, African swine fever virus
MKMHIARDSIVFLLNKHLQNTILTNKIEQECFLQADTPKKYLQYIKPFLINCMTKNITTDLVMKDSKRLEPYIILEMRDIIQMMFFRTLQKHMFFKEHTDLCTEYAQKIEASCYHYTYQQQEKTFLEEYSTRCGTINHIINCEKKSHQQQDNDALNKLISGELKPEAIGSMTFAELCPSAALKEKTEITLRSQQKVAEKTSQLYKCPNCKQRMCTYREVQTRALDEPSTIFCTCKKCGHEFIG

SEQ ID NO: 494 - protein, 243 aa, African swine fever virus
MKMHIARDSIVFLLNKYLQNTILTNKIEQECFLQADTPKKYLQYIKPFLINCMTKNITTDLVMKDSKRLEPYIILEMRDIIQMMFFRTLQKHMFFKEHTDLCTEYAQKIEASCYHYTYQQQEKTFLEEYSTRCGTINHIINCEKKSHQQQDNDALNKLISGELKPEAIGSMTFAELCPSAALKEKTEITLRSQQKVAEKTSQLYKCPNCKQRMCTYREVQTRALDEPSTIFCTCKKCGHEFIG

SEQ ID NO: 495 - protein, 24 aa, African swine fever virus
SNMGYMLTMASLARFIINTASFNK

SEQ ID NO: 496 - protein, 9 aa, African swine fever virus
LTMASLARF

SEQ ID NO: 497 - protein, 11 aa, African swine fever virus
FQSRHIHHFTL

SEQ ID NO: 498 - protein, 279 aa, African swine fever virus; identical to SEQ ID NO: 159

SEQ ID NO: 499 - protein, 10 aa, African swine fever virus
RSNTPTYLYY

SEQ ID NO: 500 - protein, 9 aa, African swine fever virus
FSNNNTFLY

SEQ ID NO: 501 - protein, 329 aa, African swine fever virus
MLRVFIFFVFLGSGLTGRIKPQVTCKYFISENNTWYKYNVTILNSSIVLPAYNTIPSNAAGISCTCHDIDYLQKNNISIHYNTSILKTFQDIRIIRCGMKNISEIAGGFGKELKFLDLRYNDLQVIDYNILRKLIRSNTPTYLYYNNLMCGKRNCPLYYFLLKQEQTYLKRLPQFFLRRINFSNNNTFLYHFLSCGNKPGHEFLEYQTKYCRTKFPEINITVNQLIAKKNTERYKSCYPLVFISILCSCISFLFLFICLLRSICKKYSCTKQDKSSHNYIPLIPSYTFSLKKHRHPETAVVEDHTTSANSPIVYIPTTEEKKVSCSRRK

SEQ ID NO: 502 - protein, 9 aa, African swine fever virus
TAKNIKVVI

SEQ ID NO: 503 - protein, 73 aa, African swine fever virus
METQKLISMVKEALEKYQYPLTAKNIKVVIQKEYNVVLPTGSINSILYSNSELFEKIDKTNTIYPPLWIRKTN

SEQ ID NO: 504 - protein, 72 aa, African swine fever virus
METQKLISMVKEALEKYQYPLTAKNIKVVIQKEHNVVLPTGSINSILYSNSELFEKIDKTNTIYPPLWIRKN

SEQ ID NO: 505 - protein, 10 aa, African swine fever virus
MLYNEPLGTY

SEQ ID NO: 506 - protein, 102 aa, African swine fever virus
MGNHPIKQDMKTCDYYHGEKKLKYMRRMLYNEPLGTYAVSSLFGCDMIVLTWNCTISGRTLHRRIHTRFGQYYHNNCYYTKIDDIIGDYPDTFYRPLYRYKP

SEQ ID NO: 507 - protein, 8 aa, African swine fever virus
RLYPHIFY

SEQ ID NO: 508 - protein, 103 aa, African swine fever virus
MGNRLIKKDLKKCEYYYGEQQNLKQIWRLLFNEPLGTYVVSSFLKKNYVVISFSCPTNTRIMHLRINICYDLYCINGEYYEKIDDFIRLYPHIFYRPLYRYKS

SEQ ID NO: 509 - protein, 103 aa, African swine fever virus; identical to SEQ ID NO: 508

SEQ ID NO: 510 - protein, 9 aa, African swine fever virus
YKIYIHSDL

SEQ ID NO: 511 - protein, 11 aa, African swine fever virus
STFSSQDFDEY

SEQ ID NO: 512 - protein, 98 aa, African swine fever virus
METFSVTASAKSDDAVCKYLEEPIDENKNSRNILRNEHGKKKLNEALNRHIIAYNPVVDWCNNYSTYSSQYFDEYKIYIHSDLMDGRPRPKKTWCVIM

SEQ ID NO: 513 - protein, 96 aa, African swine fever virus
MGTFSVTASAKSDDAVCKYLEEPIDENYRNILRNEHVKKNLNEALNRHITTYNPVVDWCNNYSTFSSQDFDEYKIYIHSDLMDGRPRPKKTWCVIM

SEQ ID NO: 514 - protein, 11 aa, African swine fever virus
AKIVEEGGEES

SEQ ID NO: 515 - protein, 10 aa, African swine fever virus
KLDPIGFINY

SEQ ID NO: 516 - protein, 10 aa, African swine fever virus
YIKTSKQEYL

SEQ ID NO: 517 - DNA, 33 bp, African swine fever virus
gcaaagattgttgaagaaggaggagaagaatcc

SEQ ID NO: 518 - protein, 11 aa, African swine fever virus
AKIVEEGGEES

SEQ ID NO: 519 - DNA, 33 bp, African swine fever virus; identical to SEQ ID NO: 517

SEQ ID NO: 520 - protein, 10 aa, African swine fever virus
KLDPIGFINY

SEQ ID NO: 521 - protein, 10 aa, African swine fever virus
YIKTSKQEYL

SEQ ID NO: 522 - protein, 16 aa, African swine fever virus
TQLYRSIQQLFLTMYK

SEQ ID NO: 523 - protein, 10 aa, African swine fever virus
SIQQLFLTMY

SEQ ID NO: 524 - protein, 145 aa, African swine fever virus
MDHYLKKLQDIYTKLEGHPFLFSPSKTNEKEFITLLNQALASTQLYRSIQQLFLTMYKLDPIGFINYIKTSKQEYLCLLINPKLVTKFLKITSFKIYINFRLKTFYISPNKYNNFYTAPSEEKTNHLLKEEKTWAKIVEEGGEES

SEQ ID NO: 525 - DNA, 438 bp, African swine fever virus
atggatcattatcttaaaaaattacaagatatttatacgaagctcgagggccatccctttctttttagcccgtcgaaaaccaatgaaaaagagtttattactctgctaaaccaggccttggcctcaacgcagctttaccgcagcatacaacagctgtttttaacgatgtataagctagatcccattgggtttattaactatattaaaacgagtaaacaagagtatttatgcctgttgattaatcctaaactcgttactaagtttttaaaaataacgagctttaaaatttacattaatttcagactgaaaactttttatataagtcctaataagtataataatttttacactgctccctctgaagaaaagactaaccatctcctaaaagaagaaaaaacttgggcaaagattgttgaagaaggaggagaagaatcctaa

SEQ ID NO: 526 - protein, 145 aa, African swine fever virus; identical to SEQ ID NO: 524

SEQ ID NO: 527 - DNA, 438 bp, African swine fever virus
atggatcattatcttaaaaaattacaagatatttatacgaagctcgagggtcatccctttctttttagcccgtcgaaaaccaatgaaaaagagtttattactctgctaaaccaggccttggcctcaacgcagctttaccgcagcatacaacagctgtttttaacgatgtataagctagatcccattgggtttattaactatattaaaacgagtaaacaagagtatttatgcctgttaattaatcctaaactcgttactaagtttttaaaaataacgagctttaaaatttacattaatttcaggctgaaaactttttatataagtcctaataagtataataatttttacaccgctccctctgaagaaaagactaaccatcttctaaaagaagaaaaaacttgggcaaagattgttgaagaaggaggagaagaatcctaa

SEQ ID NO: 528 - protein, 11 aa, African swine fever virus
MVSFENFIERY

SEQ ID NO: 529 - protein, 205 aa, African swine fever virus; identical to SEQ ID NO: 161

SEQ ID NO: 530 - protein, 18 aa, African swine fever virus
AEHSKALATLLYKLDPEY

SEQ ID NO: 531 - protein, 9 aa, African swine fever virus
LLYKLDPEY

SEQ ID NO: 532 - protein, 422 aa, African swine fever virus
MYTHVDVVGIAEASAALYVQKDRDRYLDVLTTIENFIYQHKCIITGESAHLLFLKKNIYLYEFYSNNVAEHSKALATLLYKLDPEYLTRYTVLITKIPNHWYVINVDQREFVRLYAIPAVKQHLPIPILPFYCTSALTQQELFCLGPELQLIQIYSKLCNPNFVEEWPTLLDYEKSMRMLFLEQFPQRLEMTGGKKEEKEKHESIIKKIILEMVSTRQRIVVGGYIQKNLYNHVLKNRNRLQLITSLNIYEEKDIIQQFCDSNGLKIKIRINNPLLPTNPELRRLTIYFNHNNDDDQSYLIVDMYNTGSYELVPTNQINTLDGSFLIGTPFVQARFLLVEIWVLMLIAQQTKKDTKKIIQFFINQYEMLMNSPWPSMEALFPSSSKRYLGNYVDPNALIKWAQLKLKRIPPFYPGKPDEESC

SEQ ID NO: 533 - protein, 9 aa, African swine fever virus
SSMHSGMLY

SEQ ID NO: 534 - protein, 78 aa, African swine fever virus; identical to SEQ ID NO: 163

SEQ ID NO: 535 - protein, 77 aa, African swine fever virus
MLEPILVMAPIPLVLIFLYSYFKIKLHKLITIALFLGCLFFILRDFCFPPMLWTQLHNITSSINILGNNSFQVKCNK

SEQ ID NO: 536 - protein, 93 aa, African swine fever virus
MDFFLLKKIFFFVDNRMLEPMLVMAPIPLVLIFLYSYFKIKLHKLITIALFLGCLFFILRDFCFPPMLWTQLHNITSSINILGNKSFQVQCNK

SEQ ID NO: 537 - protein, 67 aa, African swine fever virus
MDDTLPKQMTPTDTSPLKEEQAHCNNKTLENQPKNINDNKCTDSQNTDLQNTESQNTDLQNTEPSKV

SEQ ID NO: 538 - protein, 52 aa, African swine fever virus
MDDTLPKQMTPTDTSSSKEEQAHCNNKTLEKQPKNINDNKCTDSQNTESSKV

SEQ ID NO: 539 - protein, 8 aa, African swine fever virus
KNIRLIDF

SEQ ID NO: 540 - protein, 12 aa, African swine fever virus
TPAELLSQKEFY

SEQ ID NO: 541 - protein, 8 aa, African swine fever virus
YAATVARI

SEQ ID NO: 542 - protein, 8 aa, African swine fever virus
KNIRLIDF

SEQ ID NO: 543 - protein, 8 aa, African swine fever virus
YAATVARI

SEQ ID NO: 544 - protein, 12 aa, African swine fever virus
TPAELLSQKEFY

SEQ ID NO: 545 - protein, 11 aa, African swine fever virus
AVDSAVRIFLY

SEQ ID NO: 546 - protein, 11 aa, African swine fever virus
RVTDPASALLY

SEQ ID NO: 547 - protein, 15 aa, African swine fever virus
RVTDPASALLYSIEF

SEQ ID NO: 548 - protein, 10 aa, African swine fever virus
STMYSVSPVF

SEQ ID NO: 549 - protein, 27 aa, African swine fever virus
STMYSVSPVFTSGYMPLLYDLYRAGYL

SEQ ID NO: 550 - protein, 10 aa, African swine fever virus
SVSPVFTSGY

SEQ ID NO: 551 - protein, 9 aa, African swine fever virus
TSGYMPLLY

SEQ ID NO: 552 - protein, 10 aa, African swine fever virus
LLYDLYRAGY

SEQ ID NO: 553 - protein, 10 aa, African swine fever virus
AVNVCLPLVY

SEQ ID NO: 554 - protein, 8 aa, African swine fever virus
AVIYIYAY

SEQ ID NO: 555 - protein, 11 aa, African swine fever virus
KTSTLIYLRAY

SEQ ID NO: 556 - protein, 12 aa, African swine fever virus
YLRAYELFLKYL

SEQ ID NO: 557 - protein, 9 aa, African swine fever virus
RAYELFLKY

SEQ ID NO: 558 - protein, 17 aa, African swine fever virus
QTALKASLEFNTFYAFY

SEQ ID NO: 559 - protein, 11 aa, African swine fever virus
ASLEFNTFYAF

SEQ ID NO: 560 - protein, 11 aa, African swine fever virus
SLEFNTFYAFY

SEQ ID NO: 561 - protein, 1249 aa, African swine fever virus
MEEVITIAQIVHRGTDILSLNNEEIEALVDEIYSTLKGSNDIKNIRLIDFLFTLKDFVNHVRAEQSKLPDLSMPMEAYIRQLLVDPDVVPIVSEKKKELRVRPSTRKEIFLINGTHLAVPAEAPIEIYGLKLRLKSFSPQCFMRMAEIGSFSPETLGYVASGANLTNFIRVFMKCVDQETWKKNGEGVVVTTKENIIQFTHQYIELYKFLRSGGHSWLINRLAEEMVHRKLDREDQGSHISNIVETEEIEPEENIKRVIFFLKELSTMYSVSPVFTSGYMPLLYDLYRAGYLEVLWNPVEQKFLQHAEQREKEQMILQQVDMKLTEVITQARQYFKIMEEKIGRVQSDAIREILTMEGKVDDPNSILQEVIKACGKQEAELITTEYLNIKKQWELQEKNACAHLKLVKQLRSGLQYAELLKVLESIRVLYKEKNNTTNWNLCKACGFKLLCPHVDMLIQLQAAEASYDTMRTKLMKFSGINKEKENNQGLIYSYFCKICGEELAHFIQEDRTADVGVIGDLNSKLRIFIWQETMKACTFIHFGKLVDVKQFANIAVNVCLPLVYSIENIKKEEDYDPLTQLYAVIYIYAYILNLIYSSQKNKEFLTITIHGMKADSSLNAYVTFLLEKMMQQYSGIINQLSEITDQWIANNFREAFKKIIHQNGLQGLSVQDDTKVLLTEILLDPMYDYAATVARIDGSIPMHKPRTPKEAEYEFKTVIGRTPAELLSQKEFYDKIYTSKYRPDFTQLARLNDIYFQEESLRVWWGGRDEEKTSTLIYLRAYELFLKYLQNAPNFNSELAEFKTYENAYGEQKALLAQQGFYNIFDPNTGRADQRTRLFEYKRLPISTLYDERGLPHKWTIYVYKAVDSSQKPAEIEVTRKDVIKKIDNHYALADLRCSVCHVLQHEVGQLNIKKVQTALKASLEFNTFYAFYESRCPKGGLHDFQDKKCVKCGLFTYIIYDHLSQPELVHDYYNNYKDQYDKEKMSIRSIQIKKDMTTPSSETQPKPPQEPWTFDYGKIIKTAKILDISPAVIEAIGAMEGRSYADIREGQGAPPPPTSMDDPRLMAVDSAVRIFLYNYNCLRHVSTFNKPPMHVERLVKHLSYEEKEDLEKVLPNVVNEYHTTFKHLRVTDPASALLYSIEFLCVSFLTLYEIKEPSWVVNIVREFALTELNTIIQSEKLLSKPGAFNFMIFGEDFVCSGEDSSMDYISAYSSPGLFGEDIIDRLDDPFSIEDVDISLDVLDNLAPQ

SEQ ID NO: 562 - protein, 1249 aa, African swine fever virus
MEEVITIAQIVHRGTDILSLNNEEIEALVDEIYSTLKGSNDIKNIRLIDFLFTLKDFVNHVRAEQSKLPDLSMPIEAYIRQLLVDPDVVPIVSEKKKELRVRPSTRKEIFLINGTHLAVPAEAPIEIYGLKLRLKTFSPQCFMRMAEIGSFSPETLGYVASGANLTNFIRVFMKCVDQETWKKNGEGVVVTTKENIIQFTHQYIELYKFLRSGGHSWLINRLAEEMVHRKLDREDQGSHISNIVETEEIEPEENIKRVIFFLKELSTMYSVSPVFTSGYMPLLYDLYRAGYLEVLWNPVEQKFLQHAEQREKEQMILQQVDMKLTEVITQARQYFKIMEEKIGRVQSDAIREILTMEGKVDDPNSILQEVIKACGKQEAELITTEYLNIKKQWELQEKNACAHLKLVKQLRSGLQYAELLKVLESIRVLYKEKNNTTNWNLCKACGFKLLCPHVDMLIQLQAAEASYDTMRTKLMKFSGINKEKENNQGLIYSYFCKICGEELAHFIQEDRTADVGIIGDLNSKLRVFIWQETMKACTFIHFGKLVDVKQFANIAVNVCLPLVYSIENIKKEEDYDPLTQLYAVIYIYAYILNLIYSSQKNKEFLTITIHGMKADSSLNAYVTFLLEKMMQQYSGIINQLSEITDQWIANNFREAFKKIIHQNGLQGLSVQDDTKVLLTEILLDPMYDYAATVARIDGSIPMHKPRTPKEAEYEFKTVIGRTPAELLSQKEFYDKIYTSKYRPDFTQLTRLNDIYFQEESLRVWWGGRDEEKTSTLIYLRAYELFLKYLQNAPNFNSELAEFKTYENAYGEQKALLAQQGFYNIFDPNTGRADQRTRLFEYKRLPISTLYDERGLPHKWTIYVYKAVDSSQKPAEIEVTRKDVIKKIDNHYALADLRCSVCHVLQHEVGQLNIKKVQTALKASLEFNTFYAFYESRCPKGGLHDFQDKKCVKCGLFTYIIYDHLSQPELVHDYYNNYKDQYDKEKMSIRSIQIKKDMTTPSTETQPKPPQEPWTFDYGKIIKTAKILDISPAVIEAIGAMEGRSYADIREGQGAPPPPTSMDDPRLMAVDSAVRIFLYNYNCLRHVSTFNKPPIHVERLVKHLSYEEKEDLEKVLPNVVNEYHTTFKHLRVTDPASALLYSIEFLCISFLTLYEIKEPSWVVNIVREFALTELNTIIQSEKLLSKPGAFNFMIFGEDFVCSGEDSSMDDISAYSSPGLFGEDIIDRLDDPFSIEDVDISLDVLDNLAPQ

SEQ ID NO: 563 - protein, 9 aa, African swine fever virus
RAKIPAQEI

SEQ ID NO: 564 - protein, 11 aa, African swine fever virus
LTIYHWDDPEY

SEQ ID NO: 565 - protein, 10 aa, African swine fever virus
KTLKTVYPEY

SEQ ID NO: 566 - protein, 448 aa, African swine fever virus
MSNESFPETLENLLSTLQTKQQNAIQSEVIEWLHSFCETFHLKIHCHKQFIPSGEKKRAKIPAQEIQGNTQPSHHVHRVVLSRAQPVKAQESLLTTMCNGLVLDANTWTCLAIPPPAPFQQATRQVQHFYRNNFYEVVPIQDGTLLTIYYWDDPEHGPSWCLASTHGYDVSNYCWIGDKTFAELVYELLQQHSTCDVTLEKNKTRGTRLFFNNLNPDYCYTIGIRHHNLQPLIYDPQNIWAIQSTNLKTLKTVYPEYYGYIGIPGIQSQVPELPQYDLPYLIRSYKTAMNQAKNAIKNGKKDKEYFNYGYLLISRAPAITKSTSNVLLKSPLLVFLQKSVYQKKHNISNSQRLEFIILQNYLMQHFRDHFIALFPQYISYYTKYQNMLNMIIHSIATKDKDHPFAGAVVKKVLEDIENAENIIDHTTIQNYAHQSKYAMLYLSIISHF

SEQ ID NO: 567 - DNA, 1347 bp, African swine fever virus
atgtcaaatgaaagttttcccgaaacgttggaaaacctactttcgacgttacagaccaaacagcaaaacgcaattcagtcagaggtgattgaatggctgcacagcttttgtgaaacctttcacttaaaaatacactgccataaacagtttattcctagcggggaaaaaaaacgagctaaaatacctgctcaggaaatacagggaaacacgcagccctcccaccatgtgcaccgggttgttctttccagagcacagccggtcaaagcgcaggaatctctgctaacaaccatgtgcaacggactggtgctagatgcaaacacatggacatgtctagccattcctccgcctgcgccctttcaacaggcgacccgtcaagtccaacacttttaccgtaacaatttctacgaagtggttcccatccaggatggcacccttctcacaatctactactgggatgaccccgagcatggcccctcctggtgcctagcaagtacccacggatatgatgtgagtaactactgttggataggcgacaaaaccttcgccgagcttgtatacgaattgctacagcagcactctacctgcgacgtcaccctggaaaaaaataaaacgcggggaacacgtcttttctttaacaacttaaatcccgattactgctatacgattggaattcggcaccataatttacagccgcttatctatgaccctcaaaatatttgggcgattcaatctacaaacctaaaaacgcttaaaacggtatatccagaatactacggctatataggcattccaggaattcagagtcaagttcctgagcttccccagtatgatttaccttatctaatacgatcctataagactgctatgaatcaagccaaaaatgctataaaaaatggcaaaaaagacaaggaatactttaattatggctatttactcatttcgcgagcgcctgccattactaaaagtacttctaatgttttgttaaaatcgcctctgctggtatttttacaaaaaagtgtgtaccagaaaaaacacaatatctctaacagccagcggctagaatttattatactgcaaaactacttgatgcagcattttcgagatcatttcattgctctatttccgcagtacatatcctattatacgaaataccaaaacatgttgaatatgattatccatagtattgcaaccaaagataaagatcatccctttgcaggagccgtggtaaaaaaagtattggaagatattgaaaacgccgaaaacattattgatcatacaaccattcaaaactatgcccatcaaagcaagtacgctatgctttacttgtcaattatttcccatttttaa

SEQ ID NO: 568 - protein, 448 aa, African swine fever virus
MSNESFPETLENLLSMLQTKQQNAIQSEVIEWLHSFCETFHLKIHCHKQFIPSGEKKRAKIPAQETQGNTQPSHHVYRVVLSRAQPVKAQESLLTTMCNGLVLDANTWTCLAIPPPAPFQQATRQVQHFYRNNFYEVVPIQDGTLLTIYHWDDPEYGPSWCLASTHGYDVSNYCWIGDKTFAELVYELLQQHSTCDVTLEKNKTRGTRLFFDNLNPDYCYTIGIRHHNLQPLIYDPQNIWAIQSTNLKTLKTVYPEYYGYIGIPGIQSQVPELPQYDLPYLIRSYKTAMNQAKNAIKNGKKDKGYFNYGYLLISRAPAITKSTSNVLLKSPLLVFLQKSVYQKKHNISNSQRLEFIILQNYLMQHFRDHFIALFPQYISYYTKYQNMLNMIIHSIATKDKDHPFAGAVVKKVLEDIENAENIIDHTTIQNYAHQSKYAMLYLSIISHF

SEQ ID NO: 569 - DNA, 1347 bp, African swine fever virus
atgtcaaatgaaagttttcccgaaacgttggaaaacttactttcaatgttacagaccaaacagcaaaacgcaattcagtcagaggtgattgaatggctgcacagcttttgtgaaacctttcacttaaaaatacactgccataaacagtttattcctagcggggaaaaaaaacgagctaaaatacccgctcaagaaacacagggaaacacgcagccctcccaccatgtgtaccgggttgttctctccagagcacagccagtcaaagcacaggaatctctgctaacaaccatgtgcaacggactggtgctagatgcaaacacatggacatgcctagccattcctccgcctgcgccctttcaacaggcgacccgccaggtccaacacttttaccgtaacaatttctacgaagtggttcccatccaggatggcacccttctcacaatctaccactgggatgaccctgaatatggcccctcctggtgcctagcaagtacccacggatatgatgtgagtaactactgttggataggcgacaaaaccttcgccgagcttgtatacgaattgctgcagcagcactctacctgcgacgtcaccctggaaaaaaataaaacgcggggaacgcgtcttttctttgataacttaaatcccgattactgctatacgattggaatccggcaccataatttacagccgctcatctatgaccctcaaaatatttgggcgattcaatctacaaacctaaaaacgcttaaaacggtatatccagaatactacggctatataggcattccaggaattcagagtcaagttcctgagcttccccagtatgatttaccttatctaatacgatcttataaaactgctatgaatcaagccaaaaatgctataaaaaatggcaaaaaagacaagggatactttaattatggctatttactcatttcgcgagcgcctgccattactaaaagtacttctaatgttttgttaaaatcgcctctgctggtatttttacaaaaaagtgtgtaccagaaaaaacacaatatctctaacagccagcgactagaatttattatactgcaaaactacttgatgcagcattttcgagatcatttcattgctctatttccgcagtacatatcctattatacgaaataccaaaacatgttgaatatgattatccatagtattgcaactaaagataaagatcatccctttgcaggagccgtggtaaaaaaagtgttggaagatattgaaaacgccgaaaacattattgatcatacaaccattcaaaactatgcccatcaaagcaagtacgccatgctttacttgtcaattatttcccatttttaa

SEQ ID NO: 570 - protein, 19 aa, African swine fever virus
LQMAPGGSYFITDNMTEEF

SEQ ID NO: 571 - DNA, 57 bp, African swine fever virus
ctacaaatggctccaggaggatcttattttattacagataatatgactgaggagttt

SEQ ID NO: 572 - protein, 141 aa, African swine fever virus
MGNKESKYLEMCSEEAWLNIPNIFKCIFIRKLFYNKWLKYQEKKLKKSLKLLSFYHPKKDFVGIRDMLQMAPGGSYFITDNMTEEFLMLVVKHPEDGSAEFTKLCLKGSCIVIDGYYYDNLHIFISETPDIYKYPLIRYDR

SEQ ID NO: 573 - DNA, 426 bp, African swine fever virus
atgggaaacaaagaaagtaagtatctggagatgtgctcggaagaagcatggttaaacattcccaatattttcaaatgcattttcataagaaaactgttttataacaaatggcttaaataccaggaaaaaaaactaaaaaagagtttgaaactgctgagtttttaccatcccaaaaaagattttgtaggaataagagacatgctacaaatggctccaggaggatcttattttattacagataatatgactgaggagtttttaatgttagttgtaaagcatccagaagatgggagtgctgagtttactaaattatgccttaaaggaagttgcattgtgattgatggatactactatgataatcttcatatctttatttcagaaactcctgatatatacaaatatcccttgattcgttatgatagataa

SEQ ID NO: 574 - protein, 11 aa, African swine fever virus
YLMRYTQIYKY

SEQ ID NO: 575 - protein, 19 aa, African swine fever virus
YINIYMYLMRYTQIYKYPL

SEQ ID NO: 576 - protein, 124 aa, African swine fever virus
MVRLFRNPIKCLFYRRSRKIQEKKLRKSLKKLNFYHPPEDCCQIYRLLENVPGGTYFITENMTNDLIMVVKDSVDKKIKSIKLYLHGSYIKIHQHYYINIYMYLMRYTQIYKYPLICFNKYYNI

SEQ ID NO: 577 - protein, 11 aa, African swine fever virus
SIARYFDRCMY

SEQ ID NO: 578 - protein, 119 aa, African swine fever virus
MKLLALLCILIWLSQPGLNRPLSIFYMKQNLPRTYTPPIRELEYWCTYGKHCDFCWECRNGICKNKVWDDMPLIKQNDYISQCSIARYFDRCMYFIKPKSPYIHYMDCFQPTAYKGFSH

SEQ ID NO: 579 - protein, 11 aa, African swine fever virus
YQSPTTPWCFY

SEQ ID NO: 580 - protein, 119 aa, African swine fever virus
MKVFLGLLLGYSTILILTYQSPTTPWCFYEISLKIPNHHSMKCCSYPRLYEHEMFMEKWRDKNWPIIIRYYCFYLVFSFVFAGCVAFAICKNLRLSTTMKLLMLLSILVLLLSQPILNN

SEQ ID NO: 581 - protein, 11 aa, African swine fever virus
IVNRNSWGCFY

SEQ ID NO: 582 - protein, 116 aa, African swine fever virus
MKVLGLLLGYSVLILAHELPELPRTQHPPKEELPYWCTYVKNCDFCWDCQNGICKNKITNESNSMNSIVNCIVNRNSWGCFYEISVKMPNHHNMECSHPRPYTGNEIFMEKWGGGG

SEQ ID NO: 583 - protein, 10 aa, African swine fever virus
LSIPTLLYTY

SEQ ID NO: 584 - protein, 11 aa, African swine fever virus
SVFRHNEFCTY

SEQ ID NO: 585 - protein, 214 aa, African swine fever virus
MLGLQIFTLLSIPTLLYTYELELLDLTRTPPEKELEYWCTYANHCRFCWDCQDGICKNKVFENHSPILENDYIANCSVFRHNEFCTYYVTSIKPHEVYRTECPQHNHEWHEAVIRKWQKLLTYGFYLVGCVLVANYIRKRSLQTIIYLMVLLVIFFLLSQLMLYRELEAKKHKIGSIPPERELEHWCTHGKYCDFCWDCQNGICRNKVFKMIPP

SEQ ID NO: 586 - protein, 9 aa, African swine fever virus
RKEWKKDEL

SEQ ID NO: 587 - protein, 118 aa, African swine fever virus
MLVIFLGILGLLASQVSSQLVGQLRPTEDPPEEELEYWCAYMESCQFCWDCQDGTCINKIDGSAIYKNEYVKACLVSRWLDKCMYDLDKGIYHTMNCSQPWSWNPYKYFRKEWKKDEL

SEQ ID NO: 588 - protein, 205 aa, African swine fever virus
MLVIFLGILGLLASQVSSQLVGQLRPTEEPPEEELEYWCAYMESCQFCWDCQDGTCINKIDGSVIYKNEYVKSCLVSRWLDKCMYDLDKGIYHTMNCNQVLGLPNQPAGQLHPTDNPPQEELEYWCTYTENCKFCWNCQNGLCEGKLENTTILENEYVQSCIVSRWLNKCMYDLGQGIHHVMACSEPKPWNPYKILKREWKENNS

SEQ ID NO: 589 - protein, 11 aa, African swine fever virus
TVSRWNGICSY

SEQ ID NO: 590 - protein, 127 aa, African swine fever virus
VATIKVLILVLLGVVVLQAAPIRKLEDLLPTRYPPEHELVYWCTYANQCDFCWECVHGICRNRIQTDWPVIHQNDWIINCTVSRWNGICSYYEGPKNHTDHQMDCANPTSHTYPHREYMKIYERDDL

SEQ ID NO: 591 - protein, 10 aa, African swine fever virus
HIMSCTNPTY

SEQ ID NO: 592 - protein, 18 aa, African swine fever virus
HIMSCTNPTYYDWFDELM

SEQ ID NO: 593 - protein, 10 aa, African swine fever virus
MIATIALISY

SEQ ID NO: 594 - protein, 8 aa, African swine fever virus
ATIALISY

SEQ ID NO: 595 - protein, 18 aa, African swine fever virus
KQYSRMRMQAATRLLIFL

SEQ ID NO: 596 - protein, 11 aa, African swine fever virus
MQAATRLLIFL

SEQ ID NO: 597 - protein, 11 aa, African swine fever virus
CMYEAHFRIHY

SEQ ID NO: 598 - protein, 290 aa, African swine fever virus
MKVIVFLLVLAVMQPVIQSQSFPGTGELPMTRRPPKRELEYWCTYAKSCDFCWNCRHGVCKNKVFEKHPLIKKNDYIQICRVSRYNERCSYFTDSRIRRFHIMSCTNPTYYDWFDELMQIKEDRVIDTENIKHTCLCMIATIALISYVRKQYSRMRMQAATRLLIFLGFYVLLGILMTNIIMNLPLSTDNPMQMRRPPERDLKFWCTYAKHCDFCWTCKDGMCKNKVFSDHPIITQNDYIVNCTVSRWHDRCMYEAHFRIHYQHNMNCSQPKDLEWFIELKRHVINQDDL

SEQ ID NO: 599 - protein, 19 aa, African swine fever virus
YAKNYSLSTLYCIFLAIYY

SEQ ID NO: 600 - protein, 11 aa, African swine fever virus
STLYCIFLAIY

SEQ ID NO: 601 - protein, 10 aa, African swine fever virus
LLSWGASPEY

SEQ ID NO: 602 - protein, 268 aa, African swine fever virus
MVSLTTCCLKNIVNQHAYVENTVLLYHLGLRWNCKTLYQCTQCNGVNYTNSHSDQCKNKDLFLIKVIVKKNLAVARTLLSWGASPEYARLFCRNTEEEQALNVQHVADVPSSKILERLTMSYKGNDEQLLITFYLLNLSTNFSTNLREQVRFKIVSYIICDLAIHQTFKIFYAKNYSLSTLYCIFLAIYYKLYTALRKMVKIYPGLKSFAYLTGFMFDDETVMETYNSTDDEISECKNRIITIKGYYGNIHCRSDIDHMYAFSQNNFW

SEQ ID NO: 603 - protein, 12 aa, African swine fever virus
RLYVYSKTFYRK

SEQ ID NO: 604 - protein, 8 aa, African swine fever virus
YVYSKTFY

SEQ ID NO: 605 - protein, 330 aa, African swine fever virus
MQSLFNIALKALTLKNHVEFLKRDKEVLTRLGLCCKNYDLIHKCSECGNICPNGQQHGTCININYLLIYAVKRDNYMLAYRLLCWGANEKFAHYFRRPLPNLKPLLPKKELTPKDIKQLAYEHFHSDSELITVFEVFRKSRNINDCLEFFYKKNIEFEIYFARLYVYSKTFYRKSWYWFCIFMAVKHSMEHALKKITKTYIPTFYNKTTLPLVLFLSACFYENVEWMKNFFYKANKKIQQKMLSYGMEWAATHGKVRTFVCCYTLGGTASLKMYQKAYQNERYMIMALCSYLGNIQINNPWDSLNPYMMVQNKEKFLPLKFSEETQYFYI

SEQ ID NO: 606 - protein, 9 aa, African swine fever virus
NKLFDLHNL

SEQ ID NO: 607 - protein, 11 aa, African swine fever virus
KLFNDNPFPAY

SEQ ID NO: 608 - protein, 12 aa, African swine fever virus
AISYVYQHFKYL

SEQ ID NO: 609 - protein, 9 aa, African swine fever virus
AMLACVRFY

SEQ ID NO: 610 - protein, 356 aa, African swine fever virus
MVPSLQSFAKKVLASQHVSIDYHVILERCGLWWYKAPISLDCKHMLIKLPNFADGLDLNTALMLATKENNYQLIKMFTDWGADINYGLICANTPPIREFCWELGAKYQVDKKKIMHIFFKLIHPNTTSNNIILCLKFFNDNPFSAYVIIREIKSCIHWKLKNLAEDTNVLSNISDGDMLTIYCFIVALQDNLREAISYVYQHFKYLNTWWLTCALCYNKLFDLHNLYEKEKIRMDMDEMMRIACTKDNNFLTIYYCFILGANINLAMIASIRFYNMDNLFFCIDLGADAFEEAKALAEQQNYYLISHRLSLDIYSPDSSLLTLKEADPNKIYRLLKNYKSKSMLAYLNYDINDTSL

SEQ ID NO: 611 - protein, 345 aa, African swine fever virus
MFPSLQSFAKKVLARQQVSIEYHVILERCGLWWYKAPISLDCKHMLIKLPSFADGLDLNTALMLATKENNYQLIKLFTEWGADINYGLICANTPPVREFCWELGAKYRVDKKKIMHMFFKLIHPGTTSSNIILCLKLFNDNPFPAYVIIREIRSSIYWKLKRLVEDTDILSNMSDGDMLTIYCFIVALQDNLREAISYVYQHFKYLNTWWLICALCFNKLFDLHNLYEKEKIRMDVDEMMRMACTKDNNFLTIYYCFLLGANINSAMLACVRFYNMDNLFFCIDLGADAFEEAKALAEQRNYYLISHHLSLDIYSADSSLLTLKEADPNKIYHLLKNYKLKSMLA

SEQ ID NO: 612 - protein, 9 aa, African swine fever virus
NVFDLHELY

SEQ ID NO: 613 - protein, 21 aa, African swine fever virus
EMMHIACIQDYSYSAIYYCFI

SEQ ID NO: 614 - protein, 11 aa, African swine fever virus
IQDYSYSAIYY

SEQ ID NO: 615 - protein, 353 aa, African swine fever virus
MLPSLQSLTKKVLAGQCIPVDQYHVLKCCGLWWHNGPIMLHIRRNKLFIRSTCFSQGIELNIGLMKAVKENNHDLIKLFTEWGADINYGMICALTENTRDLCKELGAKEYLEREYILKIFFDTTRDKTSSNIIFCHEVFSNNPNLRIIDNLDLRGEIMWELRGLMEITFMLDHDDSFSTVLTKYWYAIAVDYDLKDAIRYFYQKYPRLHRWRLMCALFYNNVFDLHELYEIERVRMDIDEMMHIACIQDYSYSAIYYCFIMGANINQAMLVSIQNYNLGNLFFCIDLGADAFEEGKALAEQKENYLIAHALSLKHYNPVISLLSIVTDPEKINCMLKNYHSINMGIFLDYEQR

SEQ ID NO: 616 - protein, 22 aa, African swine fever virus
KTDLLNNEFSLSTLLLKYWYAI

SEQ ID NO: 617 - protein, 9 aa, African swine fever virus
SLSTLLLKY

SEQ ID NO: 618 - protein, 11 aa, African swine fever virus
SLSTLLLKYWY

SEQ ID NO: 619 - protein, 9 aa, African swine fever virus
AMLSSIQYY

SEQ ID NO: 620 - protein, 350 aa, African swine fever virus
MLPSLQSLTKKVLAGQCVPTNQHYLLKCYDLWWHDAPITFDHNLRLIKSAGIKEGLNLNTALVKAVRENNYNLIKLFAEWGADINYGLVSVNTEHTWDLCRELGAKETLNEEEILQIFIDLKFHKTSSNIILCHEVFSNNPILQKVNNIKMRIEIFWELRELIVKTDLLNNEFSLSTLLLKYWYAIAIRYNLKEAIQYFYQKYTHLNTWRLTCALCFNNVFDLHEAYEKDKIHMDIEEMMRIACIKDHNLSTMYYCYVLGANINQAMLSSIQYYNIENMFFCIDLGADVFEEGTTALGEGYELIKNILSLKIYSPATTPLPKSTDPEIIDHALKNYVSKNMMIFLTYDLR

SEQ ID NO: 621 - protein, 11 aa, African swine fever virus
VQYYNIGNIFF

SEQ ID NO: 622 - protein, 353 aa, African swine fever virus
MSLPLSLQTLVKKTIASQCLSIDEHCILKYCGLWWHDAPLKLCMDRGRIQIKSGFLGEDIDLRVALIIAVKENNYSLIKLFTEWGANINYGLLSINTKHIRELCRQLGAKETLEDNDIFRIFTRIMHNKTSGSIILCHEIFMNNPILENKFVIQLRGLIYKRLWGLIEIKETDELNGLLVKYWYAKAVQYDCKDAICFLDEKYTDLNEWRLKCLLYYNKIYELHEMYHKENIQIDVHDMICLASTKDNNPLTIYYCYALGGNINQAMLTSVQYYNIGNIFFCIDLGGNAFEEGRAIAEQKGYNFLSHSLALDIYSSDASLPLNLKDPEEISSLLKDYKSKNLSIIWEYSHNIL

SEQ ID NO: 623 - protein, 12 aa, African swine fever virus
YFYKRHKNHLYW

SEQ ID NO: 624 - protein, 357 aa, African swine fever virus
MLSLQTLAKKVVACNYLSSDYDYTLQRFGLWWDLGPIHLCNNCKQVFSYKHLQCFSEDDLCLEAALVKAVKSDNLELIRLFVDWGANPEYGLIRVPAVYLKRLCAELGGLTPVSEPRLLEILKEVARLKSCAGVLLGYDMFCHNPLLETVTRTTLDTVTYTCSNIPLTGDTAHHLLTKFWFALALRHNFTKAIHYFYKRHKNHLYWRVACSLYFNNIFDIHELCREKEICISPNLMMKFACLREKNYAAIYYCHRLGASLDYGMNLSIYNNNTLNMFFCIDLGAADFDRAQLIAHKAYMYNLSNIFLVKQLFSRDVTLVLDVTEPQEIYDMLKTYTSKNLKRAEEYLTAHPEIIVID

SEQ ID NO: 625 - protein, 10 aa, African swine fever virus
LIEFLTGFFY

SEQ ID NO: 626 - protein, 10 aa, African swine fever virus
VMDMICLDYY

SEQ ID NO: 627 - protein, 11 aa, African swine fever virus
HEWEISIDYAL

SEQ ID NO: 628 - protein, 289 aa, African swine fever virus
MNKIFLNITETINMVLIEFLTGFFYLYGKRLFSISKVMDMICLDYYTIIPAPLAMMLAARLKNYDLMKRLHEWEISIDYALLVVDDVPSIDYCLSLGARSPTRAQKRELLRDNTFNPVYKYLMNCSGFPTKREKNIPCDVQCERLQKNIIKELVFNCSVLLEMVLHTEREYAYALHCAAKHNQLPILMYCWQQSTDAESILLKTCCSDKNINCFNYCILYGGAQNLDAAMVEAAKHDARMLINYCVMLGGRSLNEAKETAAMFGHIECAQHCFKLQSYVVDTSNTDDTD

SEQ ID NO: 629 - protein, 9 aa, African swine fever virus
QVMYLLYKY

SEQ ID NO: 630 - protein, 8 aa, African swine fever virus
RLYDANIY

SEQ ID NO: 631 - protein, 237 aa, African swine fever virus
MLEIVLATLLGDLQRLRVLTPQQRAVAFFRANTKELEDFLCSDGQSEEVLSGPLLNRLLEPSGPLDILTGYHLFRQNPKAGQLRGLEVKMLERLYDANIYNILSRLRPEKVRNKAIELYWVFRAIHICHAPLVLDIVRYEEPDFAELAFICAAYFGEPQVMYLLYKYMPLTRAVLTDAIRISLESNNQVGICYAYLMGGSLKGLVSAPLRKRLRAKLRSQRKKKDVLSPHDFLLLLQ

SEQ ID NO: 632 - protein, 9 aa, African swine fever virus
YSMAILYKL

SEQ ID NO: 633 - protein, 11 aa, African swine fever virus
ILYKLTEAIQY

SEQ ID NO: 634 - protein, 9 aa, African swine fever virus
LTEAIQYFY

SEQ ID NO: 635 - protein, 9 aa, African swine fever virus
AIQYFYQRY

SEQ ID NO: 636 - protein, 11 aa, African swine fever virus
CMYDCNYTTIY

SEQ ID NO: 637 - protein, 360 aa, African swine fever virus
MPSTLQALTKKVLATQPVLKDDYCILERCGLWWHEAPITIYHTCIDEQILIKTASFKHGLTLNVALMKAVQENNHGLIELFTEWGADISFGLVTVNMECTRTYAKVRCEEKALSENKILEIFYNVQYVKTSSNIILCHELLSDNPLFLNNAQLKLRIFGELDTLSINFTLDNISFNEMLTRYWYSMAILYKLTEAIQYFYQRYSHFKDWRLICGVAYNNVFDLHEIYNKEKTNIDIDEMMQLACMYDCNYTTIYYCFMLGADINRAMITSVMNFCEGNLFLCIDLGADAFEESMEIASQTNNWILINILLFKNYSPDSSLLSIKTTDPEKINALLDEEKYKSKNMLIYEESLFHIYGVNI

SEQ ID NO: 638 - protein, 10 aa, African swine fever virus
FSEMLTRYWY

SEQ ID NO: 639 - protein, 11 aa, African swine fever virus
SEMLTRYWYSM

SEQ ID NO: 640 - protein, 9 aa, African swine fever virus
YSMAILYNL

SEQ ID NO: 641 - protein, 11 aa, African swine fever virus
ILYNLTEAIQY

SEQ ID NO: 642 - protein, 11 aa, African swine fever virus
IQYFYQRYRHF

SEQ ID NO: 643 - protein, 11 aa, African swine fever virus
STYDGNYSTIY

SEQ ID NO: 644 - protein, 356 aa, African swine fever virus
MSTPLSLQTLVKKVLATQHISKEHYFILKYCGLWWHEAPITICIDEDSQILIKSASFKEGLSLDIALMKVVQENNHDLIELFTKWGADINSSLVTVNTEYTRNLCQKLGAKEALNERDILQIFYKTRHLKTSSNIILYNELFSNNLLFQNIERLSLIVYRGLKNLSINFILDDISFSEMLTRYWYSMAILYNLTEAIQYFYQRYRHFKDWRLICGLSFNNLSDLHEVYNLEKTDIDIDEMMKLTCSTYDGNYSTIYYCFMLGADINRAMLTSVINFHIGNLFLCIDLGADAFEDSMELAKQKNNNILVEILSFKNYYSSNTSLLSIKTTDPEKINALLDEEKYESKNMLMYEELSH

SEQ ID NO: 645 - protein, 8 aa, African swine fever virus
KLTEAIQY

SEQ ID NO: 646 - protein, 17 aa, African swine fever virus
KLTEAIQYFYQRYSHFK

SEQ ID NO: 647 - protein, 8 aa, African swine fever virus
IQYFYQRY

SEQ ID NO: 648 - protein, 362 aa, African swine fever virus
MSTPISLQALAKKILATQHISKEHYFILKYCGLWWHGAPIMLSTNEDNQLMIKSAIFKDGLELNLALMKTVQENNYDLIELFTEWGADINSSLVTVNTEHTWNFCRELGAKILNEMDIVQIFYKIHRIKTSSNIILCHKLLSNNPLFQNIEELKVIICCFLEKISINFILNEITFNEMLTRYWYSIAILCKLTEAIQYFYQRYSHFKDWRLICGLSFNNVSDLHEMYHIKKVDMNIDEMIYLACMRDSNFLTIYYCFVLGADINRAMVTSVKNFYMNNLFFCIDLGANAFEESLELAKQKNHDILVEILSFKDYYSSNVSLLSLKTTDPEKINALLKNYRSKNIMRYKKLCPEIIRWARFII

SEQ ID NO: 649 - protein, 20 aa, African swine fever virus
TTNSMLNEISFSEMLTKYWY

SEQ ID NO: 650 - protein, 356 aa, African swine fever virus
MQPSTLQALAKRALATQHVSKDDYYILERYGLWWHEAPISMYIDDDNQIMIRTLCFKEGIRLNTALVLAVKENNDDLIMLFTEWGANINYGLLFINNEHTRNLCRKLGAKEELETSEILRFFFETKCKITSSNVILCHELFSNNPFLQNVNMVDLRMIIYWELKDLTTNSMLNEISFSEMLTKYWYGIAVKYNLKEAIQYFCQEYRHFDEWRLICALSFNNVFDLHEICNTTKIHMSINKMMELACMRDNNFLTIYYCFALGANANRAMLISVKNFCIENMFFCMDLGANVIEHSKTLADIYGYSIIVNILSLKIYKANPILLSKETNPEKINTLLKNYYSKNMLAYDICCIDNYL

SEQ ID NO: 651 - protein, 9 aa, African swine fever virus
FVYNRFILY

SEQ ID NO: 652 - protein, 10 aa, African swine fever virus
STYKNTESFY

SEQ ID NO: 653 - protein, 387 aa, African swine fever virus
MNSLQVLTKKVLIETKAFSNYHEDDIFILQQLGLWWENGPIGFCKQCKMVTGGSMSCSDVDSYELDRALVKAVKENQTDLIKLFVLWGADINFGIMCAKTKQTKDLCIQLGANPEFLDVGLYNMFVYLVKRKKVLLAIEIYYDNILILDSFNSNDFHLLIDFVYNRFILYLDEKEEEMTRNTLVLKFWYKFAIDFNLTKPIHYLSKKFPHLDLWRLQTAIYLGNIDEVHHAYFQENIRLGLNVMMFLACARPGNKLGIYYCFALGADLDRALERLISFNSINREINRKIRGEKRLCIEGSYLSNVYFCIGLGANPYTKKIQEIIKQKHSNIMILLFSKKKILSPHSVLQNKILDPSDVHKMISTYKNTESFYPFSSLAVKLIQQANI

SEQ ID NO: 654 - protein, 13 aa, African swine fever virus
SFDSHDFYVLIDF

SEQ ID NO: 655 - protein, 9 aa, African swine fever virus
STYEYTETF

SEQ ID NO: 656 - protein, 375 aa, African swine fever virus
MNSLQVLTKKVLIENKAFSNYHEDDIFILQQLGLWWENGPIGFCKQCKMVTSGSMSCSDVDSYELDRALVRAVKKNQTDLIKLFVLWGANINYGIICAKTERTKVLCIQLGADPKFLDVGLYNMFVDLIKQQKVLLAIDIYYDNISILDSFDSHDFYVLIDFIYNRFILNLDEKEKMIKNTYVLKFWFKIAIEFNLIKPIRFLSKKFPHLDYWRLKTAVYLGNVDEIHHAYFQENIRLDPNDMMSLACMYPQNKLGIYYCFALGANINTALETLIGFINHEVNREITFFSNYGIWSNVHFCISLGANPYTKKIQETLLRQEKNVMMKLLFKKGLLSPHSILHKKILEPSEVRKIISTYEYTETFHSFSSLRDNLR

SEQ ID NO: 657 - protein, 9 aa, African swine fever virus
DVIRLFTEW

SEQ ID NO: 658 - protein, 9 aa, African swine fever virus
VPMNIFVKY

SEQ ID NO: 659 - protein, 10 aa, African swine fever virus
RAISFFYQTY

SEQ ID NO: 660 - protein, 12 aa, African swine fever virus
YQTYGHLSMWRL

SEQ ID NO: 661 - protein, 11 aa, African swine fever virus
QTYGHLSMWRL

SEQ ID NO: 662 - protein, 11 aa, African swine fever virus
TEWGANIYYGL

SEQ ID NO: 663 - protein, 319 aa, African swine fever virus
MLSLQTLAKKAVAKQSVPEEYHYILKYCGLWWQNKPISLCHYCNYVILSSTPFKGELLHLDVALIMAIKENNYDVIRLFTEWGANIYYGLTCARTEQTQELCRKLGAKDGLNNKEIFAGLMRHKTSNNIILCHEIFDKNPMLEALNVQEMGEEIHRELKLFIFYILDNVPMNIFVKYWYAIAVKYKLKRAIFFFYQTYGHLSMWRLMCAIYFNNVFDLHEIYEQKIVHMDIDKMMQLACMQDYNFLTIYYCFVLGADIDQAITVTQWHYHTNNLYFCKDLKDLKQNTLTARPLLLPNITDPKKIYTMLKNYLPTSSNSL

SEQ ID NO: 664 - protein, 319 aa, African swine fever virus
MLSLQTLAKKAVAKQSVPEEYHYILKYCGLWWQNKPISLCHYCNYVILSSTPFKGELLHLDVALIMAIKENNYDVIRLFTEWGANIYYGLTCARTEQTQELCRKLGAKDSLNNKEIFTGLMRHKTSNNIILCHEIFDKNPMLEALNVQEMGEEIHRELKFFIFYILDNVPMNVFVKYCYAIAVKYKLKRAISFFYQTYGHLSMWRLMCAIYFNNVFDLHEIYEQKIVHMDIDKMMQLACMKDYNFLTIYYCFVLGGDIDQAITATQWHHQTNNLYFCKDLKDLKQNTLTARPLLLPNITDPKKIYTMLKNYLPTSSNSL

SEQ ID NO: 665 - protein, 11 aa, African swine fever virus
QRYAHLHRWRL

SEQ ID NO: 666 - protein, 11 aa, African swine fever virus
NQAMFHSIQFY

SEQ ID NO: 667 - protein, 13 aa, African swine fever virus
NQAMFHSIQFYNI

SEQ ID NO: 668 - protein, 9 aa, African swine fever virus
AMFHSIQFY

SEQ ID NO: 669 - protein, 11 aa, African swine fever virus
IQFYNIGNIFF

SEQ ID NO: 670 - protein, 8 aa, African swine fever virus
SMLSLNCY

SEQ ID NO: 671 - protein, 350 aa, African swine fever virus
MVLSLQTLTKKVLASQYPAKCHPHFLKCCGLWWHNGPIMYHQKKIWTPYFKNGTNLNAALVKAVEENNHDLIELFTEWGANINYGLLSVNTEHTRDLCRQLGAKEQLNDQEILRFFYTLKRDLTSSNIIFCHEVFSNNPILDTINRFEVKGMIYEQLEGLMVETDILSEMFTKYWYAMAIECNLKEAICYFYQRYAHLHRWRLMCALFYNNVFELHEVYEKERIRIDMNEMLKWACRKNYNYLTIYYCCVVLGADINQAMFHSIQFYNIGNIFFCIDLGANAFEEGKTLAHQKDNSFIASMLSLNCYNMNDSLSLKETDPEVIKRMLKDYHSKNLSIAHKHYINDGFNDI

SEQ ID NO: 672 - protein, 11 aa, African swine fever virus
IVDDYIRFLFY

SEQ ID NO: 673 - protein, 542 aa, African swine fever virus
MFSLQELCRKNIYILPYPLAKHVLQQLGLYWKGHGSLQRIGDDHVLLQQDLIFSINEALRMAGEEGNNEVVKLLLLWEGNLHYAIIGALEGDRYDLIHKYYDQIGDCHKILPLIQDPQIFEKCHELSNSCNIRCLLEHAVKHDMLSILQKHKEQIRLHMALTQILFELACHERKNDIIRWIGYSLHIHHLETIFDVAFAHKNLSLYVLGYELLMHKVNTEAAYIELPNLLSYHLRTAAAGGLLNFMLETIKHGGYLDKTVLSAAIRYKHRKIVAHFIHQVPRKTVKKLLLYAVQARAPKKTLNLLLSSLNYSVHTITKQLVHNVVIYSSTLIVKLLLMRRKNKLNLVDAVLARLVKYSTYTDIVQFMGEFSVSPERVIKMAARESRTFLIEMISKAAWGNHPQTLIHHLKQLTNTMKPQSGKDHIIYTIHYIYLNSNMLVAEEEKNIFKLAKFYANHNAVNRFKQICEDYYILDARFKTLILECFEIAVQKNYPRIANIVDDYIRFLFYRGNITEEEIREAYSLKDAEVYVDLKWLQQGEMV

SEQ ID NO: 674 - protein, 19 aa, African swine fever virus
HIMHLTSSQELFEFFHLFI

SEQ ID NO: 675 - protein, 8 aa, African swine fever virus
LLYAATLY

SEQ ID NO: 676 - protein, 18 aa, African swine fever virus
ISMMQTAIQKNYFRFFKK

SEQ ID NO: 677 - protein, 11 aa, African swine fever virus
SMMQTAIQKNY

SEQ ID NO: 678 - protein, 20 aa, African swine fever virus
SQLDSQMTVIDSVYYSIIKY

SEQ ID NO: 679 - protein, 11 aa, African swine fever virus
SQMTVIDSVYY

SEQ ID NO: 680 - protein, 8 aa, African swine fever virus
TVIDSVYY

SEQ ID NO: 681 - protein, 9 aa, African swine fever virus
SVYYSIIKY

SEQ ID NO: 682 - protein, 11 aa, African swine fever virus
LIDSLIERFRY

SEQ ID NO: 683 - protein, 542 aa, African swine fever virus
MFSLQKKALQHIYMTPENASQLTKDLLQHLGLYWNGPIVKMDTVIHLHNNIFSNRSVLKYALAKQANISIIETLVLWVEPEYALAQALKHNRKDVLECIFSYHLTTPKYHHIMHLTSSQELFEFFHLFICKSKNYNARMECLLYAATLYNFPNILEKNREYIIRHSIGNSLFAIACKERHIHLIAWFVTAGVLDTYDDSTLFNTAFRLGDYSLLEVACDLPIIYPDYLIISMMQTAIQKNYFRFFKKLLTHFNIYRPIIITDAAYYNRRKILLLLLNQNVFNNFAILCALSAAIKGHASKKTLNLLISQLDSQMTVIDSVYYSIIKYNNIDCILLLMQIKTFRLETLVSIAVHGDNIDIIAACKAFLPKDTLYHLVLKMAIISRNHKLFKLYTEKENPMYIFTTMKAIISNLVNYTVVQAVAIEYLRKFHQEKQLPIVPLLMVLAEHNYITKFKKACYAANMSDQKVKRALIKCLFIASQKNYCQIFKYCFGSLLKVLSKHERVKFFNSVVFAKKLASYYDHQNMIHLIDSLIERFRYLIKD

SEQ ID NO: 684 - protein, 9 aa, African swine fever virus
TNINIVNKY

SEQ ID NO: 685 - protein, 9 aa, African swine fever virus
YAIHHAPKL

SEQ ID NO: 686 - protein, 9 aa, African swine fever virus
YAIHHAPKL

SEQ ID NO: 687 - protein, 9 aa, African swine fever virus
TNINIVNKY

SEQ ID NO: 688 - protein, 11 aa, African swine fever virus
ATYNHRKILIY

SEQ ID NO: 689 - protein, 11 aa, African swine fever virus
RLMNFIYDRCY

SEQ ID NO: 690 - protein, 10 aa, African swine fever virus
LLAWEGNLYY

SEQ ID NO: 691 - protein, 531 aa, African swine fever virus
MFSLQNLCRKTLPDCKLPEFFDDYILQLLGLYWENHGTIQRAGNNCVLIQQHTLIPVNEALRIAASEENYEIVGLLLAWEGNLYYAIIGALEGNRYNLIRKYDDQIKDHHDILPFIDDPIIFHKCHIMRRCFFDCILYQAVKYSKFRVLLYFKYTLEDDLPLVHLLIEKACEDHNYEVIKWIYENLHVCHIIDTFDCAIAHKDLRLYCLGYTFIYNRIVPYKYHHLDILILSSLQLLHKVAAKGYLDFILETLKYDHNIDNLDVILTQAATYNHRKILTYFIPQSTYAQIEQCLFVAIKTKSSKKTLNLLLSHLNLSIKLIQKISQYVATFNSTNIIGILSMKRKKKIYLDIILTKFVKNAIFNKFVVRCMERFSINPERIVKMAARINKMMLVKKISEHVWKNHAARLKHLKHAVHTMKHKDGKNRLMNFIYEHCYYHMQGEEIFSLARFYAIHHAPKLFDVFYNCCILDTIRFKSLLLDCSHIIGKNAHDATNINIVNKYIGNLFAMGVLSKKEILQDYPSIYSKHYMP

SEQ ID NO: 692 - protein, 531 aa, African swine fever virus
MFSLQNLCRKTLPNRKLPEFFDEYILQLLGLYWENHGTIQRAGNNCVLIQQHTLIPVNEALRTAASEENYEIVSLLLAWEGNLYYAIIGALEGNRHDLIRKYDDQIKDHHEILPFIDDPVIFHKCHIMRQCFFDCILYQAVKYSKFRVLLYFKHRLEDDLPFTHLLIEKACKDHNYEVIKWIYENLHIYNMIDTFECAIAHKDLHLYCLGYRFIYNRIVPDKYHHLDIRMLSSLQLLHKVAAKGYLDFILETLKYDHNKDNINIILTQAATYNHRKILIYFIPQSTHAQIEQCLLVAIKAKSSRKTLNLLLSHLNLSINLIKKISHYVATYNSTNIIGILSMRRKKKIYLDIILTKFVKKAIFNKFVVRCMDTFSINPERILKIAARINRMMLVKKISEHVWKNHAVRLKYLKHAVHTMKHKDGKNRLMNFIYDRCYYHMQGEEIFSLARFYAIHHAPKLFDVFYDCCILDTIRFKSLLLDCSHIIGKNAHDATNINIVNKYIGNLFVMGVLSKKEILQDYPSIYSKQYMP

SEQ ID NO: 693 - protein, 9 aa, African swine fever virus
RKHIEKLLL

SEQ ID NO: 694 - protein, 9 aa, African swine fever virus
YLHETLFEL

SEQ ID NO: 695 - protein, 10 aa, African swine fever virus
AISKRDLTMY

SEQ ID NO: 696 - protein, 9 aa, African swine fever virus
KLPRYVIEY

SEQ ID NO: 697 - protein, 526 aa, African swine fever virus
MFSLQDLCRKHLFILPDVFGEHVLQRLGLYWRCHGSLQRIGDDHILIRRDLILSTNEALRMAGEEGNNEVVKLLLLWKGNLHYAVIGALQGDQYDLIHKYENQIGDFHFILPLIQDANTFEKCHALERFCGVSCLLKHATKYNMLPILQKYQEELSMRAYLHETLFELACLWQRYDVLKWIEQTMHVYDLKIMFNIAISKRDLTMYSLGYIFLFDRGNTEATLLTQHLEKTAAKGLLHFVLETLKYGGNIDTVLTQAVKYNHRKLLDYFLRQLPRKHIEKLLLLAVQEKASKKTLNLLLSHLNYSVKRIKKLLRYVIEYESTLVIKILLKKRVNLIDAMLEKMVRYFSATKVRTIMDELSISPERVIKMAIQKMRTDIVIHTSYVWEDDLERLTRLKNMVYTIKYEHGKKMLIKVMHGIYKNLLYGEREKVMFHLAKLYVAQNAATQFRDICKDCYKLDVARFKPRFKQLILDCLEIVTKKSCYSILEILEKHIISLFTMKVMTEEEKNLCLEILYKVIHYKTIQC

SEQ ID NO: 698 - protein, 531 aa, African swine fever virus; identical to SEQ ID NO: 692

SEQ ID NO: 699 - protein, 9 aa, African swine fever virus
KKYQHKHIL

SEQ ID NO: 700 - protein, 11 aa, African swine fever virus
LLLSWEADPRY

SEQ ID NO: 701 - protein, 10 aa, African swine fever virus
AVVGALESKY

SEQ ID NO: 702 - protein, 280 aa, African swine fever virus
MSSSLQELCRKKLPDCILPEFFDDYVLQLLGLHWQDHGSLQRIEKNQILVQQEPIHINEALKVAASEGNYEIVELLLSWEADPRYAVVGALESKYYDLVYKYYDLVKDCHDILPLIQNPETFEKCHELNNPCSLKCLFKHAVIHDMLPILQKYTYFLDGWEYCNQMLFELACSKKKYEMVVWIEGVLGIGKVTSLFTIAISNRDLHLYSLGHLIILERMQSCGQDPTFLLNHFLRDVSIKGLLPFVLKTIEYGGSKEIAITLAKKYQHKHILKYFETGKC

SEQ ID NO: 703 - protein, 280 aa, African swine fever virus
MSSSLQELCRKKLPDCILPEFFDDYVLQLLGLHWQDHGSLQRIEKNQILVQQEPIHINEALKVAASEGNYEIVELLLSWEADPRYAVVGALESKYYDLVYKYYDQVKDCHDILPLIQNPETFERCHELNSTCSLKCLFKHAVINDMLPILQKYTDYLDRWEYCSQMLFELACSKKKYEMVVWIEGVLGVGKVTSLFTIAISNRDLQLYSLGYSIILENLYSCGQDPKFLLNHFLRDVSIKGLLPFVIKTIEYGGSKEIAITLAKKYQHKHILKYFETWES

SEQ ID NO: 704 - protein, 9 aa, African swine fever virus
LTMGYSLLF

SEQ ID NO: 705 - protein, 11 aa, African swine fever virus
LTGFIDYYYSY

SEQ ID NO: 706 - protein, 506 aa, African swine fever virus
MFSLQDICRKHLFQLPDAFDEYILQALGLYWEKHGSLQRIRKDAVFVQRNIVLSTNEALRIAASEGNERVIKLLLSWEGNFHYVIIGALEGDQYDLIHKYDSQIKDYHMILSLIQNANTFEKCHQLSNSNMWCLIQNAIKYNMLPILQKHRNILTHEGENQELFEMACEEQKYDIVLWIGQTLMLNEPEFIFDIAFERIDFSLLTMGYSLLFDNKMSSIDIHDEEDLTSLPTEHLEKAATKGCFFFMLETLKHGGNVNMAVLSKAVEYNHRKILDHFIRRQKCLSREEIENLLLTAITNCASIKTLNLLLSYLNYSVKNIIGKIVQHVIKDGDYTIILLLKKKKINLVEPVLTGFIDYYYSYCFIKHFIQEFAIRPEKLIKMAARKGKLNMIIEFLNEKYVHKDDLGTIFKYLKTLVCTMKHKKGKETLIVLIHKIYQDIHLETKEKFKLLRFYVMHDATIQFLSMCKDCFNLAGFKPFVLECLDIAIKKNYPDMIQYIEILSKSE

SEQ ID NO: 707 - protein, 11 aa, African swine fever virus
DWLSEHVIQRL

SEQ ID NO: 708 - protein, 9 aa, African swine fever virus
NVSLLSIGY

SEQ ID NO: 709 - protein, 9 aa, African swine fever virus
LSIGYTLLF

SEQ ID NO: 710 - protein, 11 aa, African swine fever virus
ILADFIGYHSY

SEQ ID NO: 711 - protein, 13 aa, African swine fever virus
HSYTYMVDFMREF

SEQ ID NO: 712 - protein, 498 aa, African swine fever virus
MFSLQEICRKNIYFLPDWLSEHVIQRLGLYWEKHGSLQRIGDDYVLIQQDLIIPINEALRMAGEEGNDEVVQLLLLWEGNIHYAIIGALESDHYSLIRKLYDQIEDCHDILPLIQDPKIFEKCHELDKFCNILCLVLHAVKNDMLCILQEYKMHLSGEDIQVVFETACRSQKNDIVSWMGQNIAIYNSGVIFDIAFDKMNVSLLSIGYTLLFNHHINNTNENINSLLTQHLEWAAGMGLLHFMLETLKYGGDVTIIVLSEAVKYDHRKILDYFLRRKNLYQEDLEELLLLAIRADCSKKTLNLLLSYLNYSINNIRKKILQCVKEYETTVIIKILWKRKINLIEPILADFIGYHSYTYMVDFMREFSIHPEKMIKMAARESREDLIIKFSKKVCKEPKDRLHYLKSLVYTMRHKEGKQLLIYTIHNLYKACHLESKEMFNLARFYARHNAVIQFKSICHDLSKLNINIKNLLLECLGIAIKKNYFQLIKTIETDMRYE

SEQ ID NO: 713 - protein, 498 aa, African swine fever virus
MFSLQEICRKNIYFLPDWLGEHVIQRLGLYWEKHGSLQRIGDNYVLIQQDLIIPINEALRMAGEEGNDEVVQLLLLWEGNIHYAIIGALESDHYSLIRKLYDQIEDCHDILPLIQDPKLFEKCHELDKSCNILCLVLHAVKNDMLCILQEYKMHLSGEDIQVVFETACRSQKNDIVSWMGQNIAIYNPEVIFDIAFDKMNVSLLSIGYTLLFNHHINNTNENINSLLTQHLEWAAGMGLLHFMLETLKYGGDVTIIVLSEAVKYDHRKILDYFLRRKNLYQEDLEELLLLAIRADCSKKTLNLLLSYLNYSINNIRKKILQCVKEYETTVIIKILRKRKINLIEPILADFIGYHSYTYMVDFMREFSIHPEKMIKMAARESREDLIIKFSKKVCKEPKDRLHYLKSLVYTMRHKEGKQLLIYTIHNLYKACHLESKEMFNLARFYARHNAVIQFKSICHDLSKLNINIKNLLLECLGIAIKKNYFQLIKTIETDMRYE

SEQ ID NO: 714 - protein, 10 aa, African swine fever virus
SQIQDWHILL

SEQ ID NO: 715 - protein, 9 aa, African swine fever virus
LVDIIHSIY

SEQ ID NO: 716 - protein, 525 aa, African swine fever virus
MFSLQDLCRKNIFFLPNDFSKHTLQWLGLYWKEHGSVHRAEKDSIMIQNELVLSINDALQLAGEEGDTDVVQLLLLWEGNLHYAIIGALKTEKYNLICEYHSQIQDWHILLPMIQDPETFEKCHDLSLGCDFICLLQHAVKYNMLSILVKYKEDLLNARIRHRIQSLFVLACENRRIEIIDWIGQNLPIPEPDAIFSIAVATRDLELFSLGYKIIFDYMQRQGIIQLTNGVRMVVLNRHISMAIDNGLLPFVLETLKHGGNIHRALSYAVTHNRRKILDYLIRQKNIAPNTIERLLYLAVKNQSSRKTLNLLLSYINYKVKNVKKLVEHVVNEKSTLVLKILLEKKENLVDAVLTRLVKHSTYFQVREFIQEFSISPEKFIKIAVREKKNVLIEAISEDIWENPTERITYLKQIVHTIKYESGRRFLVDIIHSIYQSYSLKHEDILKLATFYVKHNAITHFKDLCKYLWLNRGTESKKLFLECLEIADEKEFPDIKSIVSEYINYLFTAGAITKEEIMQAYDALE

SEQ ID NO: 717 - protein, 8 aa, African swine fever virus
NSTLVIRI

SEQ ID NO: 718 - DNA, 24 bp, African swine fever virus
aactctactcttgtgataagaatc

SEQ ID NO: 719 - protein, 8 aa, African swine fever virus
NSTLVIRL

SEQ ID NO: 720 - DNA, 24 bp, African swine fever virus
aactctactcttgtgataagactc

SEQ ID NO: 721 - protein, 10 aa, African swine fever virus
SQIQDWHVLL

SEQ ID NO: 722 - protein, 469 aa, African swine fever virus
MFSLQDLCRKNTFFLPDNFSKHTLYLLGLYWKGHGSIQRTMNDGVLIEHNLNLSINEALILAGEEGNNDVVQLLLLWEGNLHYAIIGALKTEKYGLICEYHSQIQDWHVLLPLIQDPETFEKCHDLSLECDLSCLLQHAVKYNMLSILVKYKEDLLNVLFRQQIQGLFILACEHRRIEILTWMGQNLPIPDPEPIFSIAVVTKDLEMFSLGYKIVFEYMENQGLFHLTQVVRMVMLNHHLGMVINKGLLPFVLETLKHGGNVNRALSYAVTQNKRKILDHVVRQKNIPHKTIERMLHLAVKKHAPRKTLNLLLSYINYKVKNVKKLLEHVVKYNSTLVIRILLEKKKNLLDATLTRYVKDSTYFQVKEFMQDFSISPEKFIKIAVREKRNVLIKGISEDIWENPAERIRNLKQIVCTIKYESGRQFLINIIHTIYQSYSLKPEEILKLATFMSNTMQPPILKISANIFG

SEQ ID NO: 723 - DNA, 1410 bp, African swine fever virus
atgttctcccttcaggacctctgtcggaagaacaccttcttccttccagataattttagcaagcataccctgtatttgctggggttatactggaagggacatggatctatccaaagaacaatgaatgatggtgtactgatagagcataatcttaatctttccatcaatgaagccttaatccttgcaggagaagagggaaacaatgatgtagtacaactcttattgctatgggaaggaaatcttcattatgccatcataggagctttgaagactgagaaatatggcttaatatgtgagtaccatagccaaattcaggactggcatgttctcctccccttgattcaagatccagaaacattcgaaaaatgtcatgatttaagccttgaatgtgatctttcatgccttctccaacatgctgtaaaatataacatgctttctattcttgttaaatataaagaggatctattaaatgtactatttaggcaacaaattcaaggactatttattttagcatgtgaacatcggaggattgagattcttacgtggatgggtcaaaatctgccaattcctgatcctgagcctatttttagcattgctgttgtcacaaaagatttagaaatgttttccttagggtacaagattgtttttgaatacatggaaaatcaaggactatttcatttaacccaggtagttcgtatggttatgctaaatcatcaccttggcatggtaataaataaaggacttttaccctttgtgctggaaactttaaaacatggtgggaatgtaaatagagccttatcttatgctgtcacacaaaacaaaagaaagattttagaccatgttgttcgccaaaagaatataccccataaaaccattgaaagaatgttgcatctggctgtaaaaaagcatgctcccaggaaaactctgaacttgttactatcttacataaattacaaggtgaaaaatgttaaaaagttgttagaacatgtagtgaaatacaactctactcttgtgataagaatcttgttagaaaaaaagaaaaacctgctggatgctactttgacaagatatgtcaaagattctacatactttcaggtgaaagaatttatgcaagacttctccatcagcccagaaaaattcattaaaatagctgtgcgggaaaagaggaatgtgttgatcaagggtatttctgaagatatttgggaaaatcccgcggaaagaatcaggaatcttaagcagatagtgtgtaccataaaatatgaaagtggaagacaattcctgataaatatcattcacaccatttaccagagttattctttgaaacctgaagaaattcttaaactggcaacatttatgtcaaacacaatgcaaccacccattttaaagatctctgcaaatatctttggctga

SEQ ID NO: 724 - protein, 527 aa, African swine fever virus
MFSLQDLCRKNTFFLPSDFSKHTLHLLGLYWKGHGSIQRIKNDGVLIEHDLTLSINEALILAGEEGNNEVVKLLLLWEGNLHYAIIGALRTENYNLVCEYHSQIQDWHVLLPLIQDPETFEKCHDLSLECDLSCLLQHAVKYNMLSILVKYKEDLLNVLFRQQIQGLFILACENRKLEILTWMGQNLPIPDPEPIFSIAVVTKDLEMFSLGYKIVFEYMENQGLHLTQVVRMVMLNHHFGMVINKGLLPFVLEILNYGGNVNRALSYAVTQNKRKILDHVVRQKNIPHKTIERMLHLAVKKHAPRKTLNLLLSYINYKVKNVKKLLEHVVKYNSTLVIRLLLEKKKNLLDATLTRYVKDSTYFQVKEFMQDFSISPEKFIKIAVREKRNVLIKGISEDIWENPAERIRNLKQIVCTIKYESGRQFLINIIHTIYQSYSLKPEEILKLATFYVKHNATTHFKDLCKYLWLNRRTESKKLFLECLEIADKKEFPDIKSIVSEYINYLFTAGAITKEEIMQAYALEYAMY

SEQ ID NO: 725 - DNA, 1584 bp, African swine fever virus
atgttctcccttcaggacctctgtcggaagaacaccttcttccttccaagtgattttagcaagcataccctgcatttgctggggttatactggaaggggcatggatctatccaaaggataaagaatgatggtgtgcttatagagcatgatcttactctttccatcaatgaagccttaattcttgcaggagaagagggaaacaatgaagtagtaaagctcttgttactatgggaaggaaatcttcattatgccatcataggagctttgaggactgagaactataacctagtatgtgagtaccatagtcaaattcaggactggcatgttctcctccctttgattcaagatccagaaacattcgaaaaatgtcatgatttaagccttgaatgtgatctttcatgccttctccaacatgctgtaaaatataacatgctttcgattcttgttaaatataaagaggatctactaaatgtactatttaggcaacaaattcaaggactatttattttagcatgtgaaaatcggaagcttgagattcttacgtggatgggtcaaaatctgccaattcctgatcctgagcctatttttagcattgctgttgtcacaaaagatttagaaatgttttccttagggtacaagattgtttttgaatacatggaaaaccaaggacttcatttaacccaggtagttcgtatggttatgctaaatcatcactttggcatggtaataaataaaggacttttaccctttgtgctggaaattttaaattatggtgggaatgtaaatagagccttatcttatgctgtcacacaaaataaaagaaagattttagaccatgttgttcgccaaaagaatataccccataaaaccattgaaagaatgttgcatctggctgtaaaaaagcatgctcccaggaaaactctgaacttgttactatcttacataaattacaaggtgaaaaatgttaaaaagttgttagaacatgtagtgaaatacaactctactcttgtgataagactcttgttagaaaaaaagaaaaacctgctggatgctactttgacaagatatgtcaaagattctacatactttcaggtgaaagaatttatgcaagacttctccatcagcccagaaaaattcattaaaatagctgtgcgggaaaagagaaatgtgttgatcaagggtatttctgaagatatttgggaaaatcccgcggaaagaatcaggaatcttaagcagatagtgtgtaccataaaatatgaaagtggaagacaattcctgataaatatcattcacaccatttaccagagttattctttgaaacctgaagaaattcttaaattggcaacattttatgtcaaacacaatgcaaccacccattttaaagatctctgcaaatatctttggctgaacagaagaacagaaagtaagaaactgtttttagagtgcttggaaattgctgataagaaggagtttcctgatattaaaagtattgtgagtgaatacattaactatttgtttactgcaggagctattaccaaggaagaaatcatgcaagcctatgctttggagtatgccatgtattaa

SEQ ID NO: 726 - protein, 9 aa, African swine fever virus
YNIHNITGY

SEQ ID NO: 727 - protein, 9 aa, African swine fever virus
RQYDLIQKY

SEQ ID NO: 728 - protein, 9 aa, African swine fever virus
NMLPIFQKY

SEQ ID NO: 729 - protein, 10 aa, African swine fever virus
SSINYCVNPF

SEQ ID NO: 730 - protein, 9 aa, African swine fever virus
YNIHNITGY

SEQ ID NO: 731 - protein, 9 aa, African swine fever virus
STYTEIVKY

SEQ ID NO: 732 - protein, 506 aa, African swine fever virus
MFSLQDLCRKNLFLPLEPLGKHVVQRLGLYWEGHGSLKRVGDCFICVDKIWILSIHKAIQIAASEGNENIVKLFLLWKGSLQYAIIGALEGRQYDLIQKYYNQIGDCHEILPLIQDPEIYERCHELNVTCTFQCLFQHAIRDNMLPIFQKYGEDLNGNRRMVQLLYEMACRLQNYDIIKWIGFNLHVYNLEAIFSIAFVRKDLTLYSLGYMLLLGRMSTEDRNFISIITRHLEYASKKGLFDFVLESLKYGGQVDTVLFQAVKYNHRKILAHFIHEIPRETVEKLILHAVESRASRKTFNLLLSSINYCVNPFVKKLLHTVVKHKYMLIIKLLLERPKKKINLVDAALFKLVKYSTYAEIVKFMKEFSVDPERVVKMAARLMRVDLIKKISNDAWENKLERIKHLKQMVNTMNHRNGKNLLMYNIHNITGYTCLNTKEAFNLTRFYAVHNATCLFKEMCKSCFVHDKIQFRELLEDCLHIANRHDYIQIAETADECIKYIDLITPK

SEQ ID NO: 733 - protein, 506 aa, African swine fever virus
MFSLQDLCRKNLFLPLEPLGKHVVQRLGLYWEGHGSVKRVGDCFICVDQIWMLSIHKAIQIAASEGNENIVKLFLLWKGSLQYAIIGALEGRQYDLIQKYYNQIGDCHQILPLIQDPEIYERCHELNVTCTFQCLFQHAIRDNMLPIFQKYGEDLNGNRRMVQLLYEMACRLQNYDIIKWIGSNLHVYNLEAIFSIAFVRKDLTLYSLGYMLLLGRMSTEDRNFISIITRHLEYASKKGLFDFVLESLKYGGQVDTVLFQAVKYNHRKILAHFIHEIPRETVEKLILHAVESRASRKTFNLLLSSINYCVNPFVKKLLHAVVKHKYMLIIKLLLERPKKKINLVDAALFKLVKYSTYTEIVKYMGEFSVDPKRVVKMAARLMRVDLIKKISNDAWEDKLERIKHLKQMVNTMNHRNGKNLLMYNIHNITGYTYLNTKEAFNLTRFYAVHNATCLFKEMCKSCFVHDKIQLRELLEDCLHIANRHDYIQIAETADECIKYIDLITFK

SEQ ID NO: 734 - protein, 103 aa, African swine fever virus
MKVFLGLLLGYSTILILTYQSPTTQWCFYEISLKILNHHSMEKWRDKNWSIIIRYYCFYLVFSFAFAGCVAFAICKNLRLCTTMKLLMLLNILVLLSQPILNN

SEQ ID NO: 735 - protein, 119 aa, African swine fever virus; identical to SEQ ID NO: 580

SEQ ID NO: 736 - protein, 158 aa, African swine fever virus
MGGGGDYWPIIIRHCCFYLVFSIAFVGYIVFAYYKNLHLNTAMKLLALLCILIWLSQPGLNRPLSIFYMKQNLPRTYTPPIRELEYWCTYGKHCDFCWECRNGICKNKVWDDMSSVQEHSYPMEHCMIHRQCKYIRDGPIFQVECTMQTSDATHLINA

SEQ ID NO: 737 - protein, 274 aa, African swine fever virus
MKVLLGLLLGYSVLILAHELPDLPRTQHPPKSELSYWCTYVPQCDFCWDCQDGICKNKITESRFIDSNHSIVNCRVFRDSKTQSCLYEISSKMPNHFSMECLHPRPYTGNEIFMQTWGGGGGDHQQLSIKQYCLYFIIGIAYTGCFVCALCKNLRLSTTMKLFVLLSILVWLAQPVLNRPLSIFYTKQILPRTYTPPMRELEYWCTYGKHCDFCWDCKNGICKNKVLDDMPLIVQNDYISKCSITRFIDRCMYFIEPKIPYIHYMNCSLPTYFS

SEQ ID NO: 738 - protein, 128 aa, African swine fever virus
MKVLLGLLLGHSVLILAHELPDLPRTQHPPKSELSYWCTYVPQCDFCWDCQDGICKNKITESRFIDSNHSIVNCRVFRDSKTQSCLYEISSKMPNHFSMECLHPRSYTGNEIFMQTWGGGGVTINNYL

SEQ ID NO: 739 - protein, 116 aa, African swine fever virus; identical to SEQ ID NO: 582

SEQ ID NO: 740 - protein, 270 aa, African swine fever virus
MLGLQIFTLLSIPTLLYTYEIEPLERTSTPPEKELGYWCTYANHCRFCWDCQDGICRNKAFKNHSPILENDYIANCSIYRRNDFCIYYITSIKPHKTYRTECPQHINHERHEADIRKWQKLLTYGFYLAGCILAVNYIRKRSLQTVMYLLVFLVISFLLSQLMLYGELEDKKHKIGSIPPKRELEHWCTHGKYCNFCWDCQNGICKNKAFKNHPPIGENDFIRYDCWTTHLPNKCSYEKIYKHFNTHIMECSQPTHFKWYDNLMKKQDIM

SEQ ID NO: 741 - protein, 214 aa, African swine fever virus; identical to SEQ ID NO: 585

SEQ ID NO: 742 - protein, 268 aa, African swine fever virus
MVSLTTCCLKNIVNQHACVENTVLLYHLGLRWNCKTLYQCTQCNGVNYTNSHSDQCKNKDLFLMKVIVKKNLAVTRTLLSWGASPEYARLFCRNTEEEQALNVQHVADVSSSKILERLTMSYKENDEQLLITFYLLNLSTKFSTNLREQVRFNIVSYIICDLAIHQTFKTFYAKNYSLSTLYCIFLAIYYKLYTALRKMVKIYPGLKRFAYLIGFMFDDETVMETYNSTDDEISECKNRIIAIKGYYGNIHCRSDIDHMYAFSQNDYW

SEQ ID NO: 743 - protein, 268 aa, African swine fever virus; identical to SEQ ID NO: 602

SEQ ID NO: 744 - protein, 328 aa, African swine fever virus
MLSLFNIALKTLKNHIEFLKHDKDILTHLGLCCKNYDLIHKCSECGNICPNRQQHGTCININYLLIYAVKCDNYMLAYRLLCWGANEKFAHYFRRPLPNLKPLLPKKELTPKDIKQLAYEHFYSDSELITVFEVFRRCRNINDCLEFFYKKNLEFEIYFARLHVYSKTFYRKSWYWFCIFMAVKHGMKQALKKITKTYIPTFYNKTTLNLVLFLSACFYENVEWMKYFFYKANKKIQQRMLSYGMEWAATHGKVRTFVCCYTLGGTASLKMYQKAYQNERYMIMALCSYLGNIQINNPWDNLNPYMMMQNKEKFLPLKFSEETQYFYI

SEQ ID NO: 745 - protein, 387 aa, African swine fever virus; identical to SEQ ID NO: 653

SEQ ID NO: 746 - protein, 356 aa, African swine fever virus; identical to SEQ ID NO: 610

SEQ ID NO: 747 - protein, 345 aa, African swine fever virus; identical to SEQ ID NO: 611

SEQ ID NO: 748 - protein, 353 aa, African swine fever virus
MLPSLQSLTKKVLAGQCVSVDHYHILKCCGLWWHNGPIMLHIRRNKLFIRSTCFSQGIELNIGLMKAVKENNHDLIKLFTEWGADINYGMICALTENTRDLCKELGAKEYLEREYILKIFFDTTRDKTSSNIIFCHEVFSNNPNLRIIDNLDLRGEIMWELRGLMEITFMLDHDDSFSTVLTKYWYAIAVDYDLKDAIRYFYQKYPRLHRWRLMCALFYNNVFDLHELYEIERVRMDIDEMMHIACIQDYSYSAIYYCFIMGANINQAMLVSIQNYNLGNLFFCIDLGANAFEEGKALAEQKENYLIAHALSLKHYNPVISLLSNVMDPEKINYMLKNYHSINMGIFLDYEQR

SEQ ID NO: 749 - protein, 353 aa, African swine fever virus; identical to SEQ ID NO: 615

SEQ ID NO: 750 - protein, 117 aa, African swine fever virus
MDIEEMMRIACIKDHNLSTMYYCYMLGANINQAMLTSIQYYNIENMFFCMDLGADVFEEGTTALGEGYELIKNILSLKIYSPTTIPLPKSTDPEIIDHALKNYFSKNMMIFLSYDLR

SEQ ID NO: 751 - protein, 350 aa, African swine fever virus; identical to SEQ ID NO: 620

SEQ ID NO: 752 - protein, 357 aa, African swine fever virus
MLSLQTLAKKVVACNYLSSDYDYTLQRFGLWWDLGPIHLCNNCKQVFSYKHLQCFSEDDLCLEAALVKAVKSDNLELIRLFVDWGANPEYGLIRVPAVYLKRLCAELGGLTPVSEPRLLEILKEVANLKSCAGVLLGYDMFCHNPLLETVTRTTLDTVTYTCSNIPLTGDTAHLLLTKFWFALALRHNFTKAIHYFYKRHKNQLYWRVACSLYFNNIFDIHELCREKEICISPNLMMKFACLREKNYAAIYYCHRLGASLDYGMNLSIYNNNTLNMFFCIDLGAADFDRAQLIAHKAYMYNLSNIFLVKQLFSRDVTLVLDVTEPQEIYDMLKTYTSKNMKRAEEYLTAHPEIIVID

SEQ ID NO: 753 - protein, 357 aa, African swine fever virus; identical to SEQ ID NO: 624

SEQ ID NO: 754 - protein, 276 aa, African swine fever virus
MVLIEFLTGFFYLYGKRLFSISKVMDMICLDYYTIIPAPLAMMLAARIKNYDLMKRLHEWEISVDYALLVVDDVPSIDFCLSLGAKSPTRAQKRQLLRDNTFNPVYKYLMNCSGFPTRREKNIPCDVQCERLQKNIIKELVFNCSVLLEMVLHTEREYAYALHCAAKHNQLPILMYCWQQSTDAESILLKTCCSDKNINCFNYCILYGGAQNLNAAMVEAAKHDARMLINYCVMLGGRSLNEAKETAAMFGHIECAQHCFELQSYVMDALNADDAD

SEQ ID NO: 755 - protein, 289 aa, African swine fever virus
LNKIFLNITETINMVLIEFLTGFFYLYGKRLFSISKVMDMICLDYYTIIPAPLAMMLAARLKNYDLMKRLHEWEISIDYALLVVDDVPSIDYCLSLGARSPTRAQKRELLRDNTFNPVYKYLMNCSGFPTKREKNIPCDVQCERLQKNIIKELVFNCSVLLEMVLHTEREYAYALHCAAKHNQLPILMYCWQQSTDAESILLKTCCSDKNINCFNYCILYGGAQNLDAAMVEAAKHDARMLINYCVMLGGRSLNEAKETAAMFGHIECAQHCFKLQSYVVDTSNTDDTD

SEQ ID NO: 756 - protein, 360 aa, African swine fever virus
MSTPLSLQALAKKILATQHISKNHYFILKYCGLWWHGAPIMFSTNEDNQLMIKSAIFKDGLELNLALMKAVQENNYDLIELFTEWGADINSSLVTVNTEHTWNFCRELGAKILNEMDIVQIFYKIHRIKTSSNIILCHKLLSNNPLFQNIEELKIIICCFLEKISINFILNEITLNEMLARLWYSMAVRYHLTEAIQYFYQRYRHFKDWRLICGVAYNNVFDLHEIYNKEKTNIDIDEMMQLACMYDCNYTTIYYCCMLGADINRAMITSVMNFCEGNLFLCIDLGADAFEESMEIASQTNNWILINILLFKNYSPDSSLLSIKTTDPEKINALLDEEKYKSKNMLIYEESLFHIYGVNI

SEQ ID NO: 757 - protein, 362 aa, African swine fever virus; identical to SEQ ID NO: 648

SEQ ID NO: 758 - protein, 267 aa, African swine fever virus
MGYFLLITSILETYAENWGAKEELETSEILRFFFETKCKITSSNVILCHELFSNNPFLQNVNMVDLRMIIYWELKDLPTNSMLNEISFSEMLTKYWYGIAVKYNLKEAIQYFCQEYRHFDEWRLICALSFNNVFDLHEICNTTKIHMSINKMMELACMRDNNFLTIYYCFALGANANRAMLISVKNFCIENMFFCMDLGANVIEHSKTLADIYGYSIIVNILSLKIYKANPILLSKETNPEKINTLLKNYYSKNMLAYDICCIDNYL

SEQ ID NO: 759 - protein, 356 aa, African swine fever virus; identical to SEQ ID NO: 650

SEQ ID NO: 760 - protein, 386 aa, African swine fever virus
MNSLQVLTKKVLIETKAFSKYHEDDIFILQQLGLWWENGPIGFCKQCKMVTDGSMSCSDVNSYELDRALVKAVKENQTDLIKIFLSWGAEINFGIMCAKTKQTKDLCIQLGADPEFLDVGLYNMFVYLIKQKKVLLAIDIYYDNISILDSFDSHDFHVLIDFVYNRFILYLDEKEEEMTRNTLVLKFWYKFAIDFKLTKPIRYLSKKFPHLDLWRLQTAIYLGNIDEVHHAYFQENIRLSLNVMMFLACARPGNKLGIYYCFALGADLDRALERLISFNSINREINRKISGETRLCIEGSYLSNVYFCIGLGANPYTKKIQETIKQKHSNIMILLFSKKKILSPHSVLQNKILDPSDVRKMISTYKNTESFYPFSSLAVKLIQQAK

SEQ ID NO: 761 - protein, 387 aa, African swine fever virus; identical to SEQ ID NO: 653

SEQ ID NO: 762 - protein, 375 aa, African swine fever virus
MNSLQVLTKKVLIENKAFSEYHEDDIFILQQLGLWWHNGPIGFCKQCKMVTSGSMSCSDVDSYELDRALVRAVKKNQTDLIKLFVLWGANINYGIICAKTERTKDLCIELGANPEFLDVGLYNMFVDLIKQQKVLLAIDIYYDNISILDSFDSHDFYVLIDFIYNCFILNLDEKEKMIKNTYVLKFWFKIAIEFNLIKPIRFLSKKFPHLDYWRLKTAVYLGNVDEIHHAYFQENIRLDPNDMMSLACMYPQNKLGIYYCFALGANINTALETLIGFINHEVNREITFFSNYGIWSNVHFCISLGANPYTKKIQETLLRQEKNVIMKLLFKKGLLSPHSILHKKILEPSEVRKIISTYEYTETFHSFSLLRDNLR

SEQ ID NO: 763 - protein, 375 aa, African swine fever virus; identical to SEQ ID NO: 656

SEQ ID NO: 764 - protein, 319 aa, African swine fever virus
MLSLQTLAKKAVAKQSVPEEYHYILKYCGLWWQNKPISLCHYCNYVILSSTPFKGELLHLDVALIMAIKENNYDVIRLFTEWGANIYYGLTCARTEQTQELCRKLGAKDGLNNKEIFAGLMRHKTSNNIILCHEIFDKNPMLEALNVQEMGEEIHRELKLFIFYILDNVPMNIFVKYWYAIAVKYKLKRAIFFFYQTYGHLSMWRLMCAIYFNNVFDLHEIYEQKIVHMDIDKMMQLACMQDYNFLTIYYCFVLGADIDQAITVTRWHYHTNNLYFCKDLKDLKQNTLTARPLLLPNITDPKKIYTMLKNYLPTSSNSL

SEQ ID NO: 765 - protein, 319 aa, African swine fever virus; identical to SEQ ID NO: 664

SEQ ID NO: 766 - protein, 357 aa, African swine fever virus
MFSLQDLCRKHLFILPDVFGEHVLQRLGLYWRCHGSLQRIGDDHILIRRDLILSTNEALRMAGEEGNNEVVKLLLLWKGNLHYAVIGALQGDQYDLIHKYENQIGDFHFILPLIQDANTFEKCHALERFCGVSCLLKHATKYNMLPILQKYQEELSMRAYLHETLFELACLWQRYDVLKWIEQTMHVYDLKIMFNIAISKRDLTMYSLGYIFLFDRGNTEATLLTQHLEKTAAKGLLHFVLETLKYGGNIDTVLTQAVKYNHRKLLDYFLRQLPRKHIEKLLLLAVQEKASKKTLNLLLSHLNYSVKRIKKLLRYVIEYESTLVIKILLKKKSKPDRCHVGKDGKIFFCDESEDDHG

SEQ ID NO: 767 - protein, 526 aa, African swine fever virus
MFSLQDLCRKHLFILPDVFGEHVLQRLGLYWRCHGSLQRIGDDHILIRRDLILSTNEALRMAGEEGNNEVVKLLLLWKGNLHYAVIGALQGDQYDLIHKYENQIGDFHFILPLIQDANTFEKCHALERFCGVSCLLKHATKYNMLPILQKYQEELSMRAYLHETLFELACLWQRYDVLKWIEQTIHVYDLKIMFNIAISKRDLTMYSLGYIFLFDRGNTEATLLTQHLKKTAAKGLLHFVLETLKYGGNIDTVLTQAVKYNHRKLLDYFLRQLPRKHIEKLLLLAVQEKASKKTLNLLLSHLNYSVKRIKKLPRYVIEYESTLVIKILLKKRVNLIDAMLEKMVRYFSATKVRTIMDELSISPERVIKMAIQKMRTDIVIHTSYVWEDDLERLTRLKNMVYTIKYEHGKKMLIKVMHGIYKNLLYGEREKVMFYLAKLYVAQNAATQFRDICKDCYKLDVARFKPRFKQLILDCLEIITKKSCYSILEILEKHIISLFTMKVMTEEEKNLCLEILYKVIHYKTIQC

SEQ ID NO: 768 - protein, 505 aa, African swine fever virus
MFSLQDICRKYLFQLPDSFDEYTLQVLGLYWEKHGSLQRIRKDAVFVQRNLIISINEALRIAASEGNGRVVKLLLSWEGNFHYVIIGALEGDHYDLIHKYGSQIEDYHMILSSIHNANTFEKCHELSNCDMWCLIQNAIKYNMLPILQKHRNILTHEGENQELFEMACEEQKYDIVLWIGQTLMLNEPEFIFDIAFERIDFSLLTMGYSLLFNNKMSSIDIHDEEDLISLLTEHLEKAATKGCFFFMLETLKHGGNVNMAVLSKAVEYNHRKILDYFIRQKCLSRKDIEKLLLVAISNSASKKTLNLLLSYLNHSVKNIIGKIVQSVLKNGDFTIIIFLKKKKINLVEPALIGFINYYYSYCFLEQFIHEFDIRPEKMIKMAARKGKLNMIIEFLNEKYVHKDDLGAIFKFLKNLVCTMKHKKGKETLIVLIHKIYQVIQLETKEKFKLLRFYVMHDATIQFISMYKDCFNLAGFKPFLLECLDIAIKKNYPDMIRNIETLLKCE

SEQ ID NO: 769 - protein, 506 aa, African swine fever virus; identical to SEQ ID NO: 706

SEQ ID NO: 770 - protein, 528 aa, African swine fever virus
MFSLQDLCRKNTFFLPNDFSKHTLQRLGLYWKEHGSVHRIEKDSIMIQNELVLSINDALQLAGEEGDTDVVQLLLLWEGNLHYAIIGALKTENYNLVCEYHSQIQDWHILLPLIQDPETFEKCHDLSLGCDLICLLQHAVKCDMLSILVKYKEDLLNVRIRHRTQSLFVLACENRRFEIIEWIGQNLSIPEPEAIFSIAIVTKDVELFSLGYKIIFDYMQRQGIFQLTNVVRMLLLNRHIGMAIEKGLLPFILETLKYGGSVKRALSYAVIDNKRKIIDYLVRHENIPRGTIERLLHLAVKKQSSRKTLNLLLSYINYKVKNVKKLVEHVVDHKSTLVLKILLEKKENLVDAVLTRLVKHSTYFQVREFIQEFSISPEKFIKIAVREKKNVLIEAISEDIWENPTERITYLKQIVHTIKYESGRRFLIDIIHSIYQSYSLKHEDILKLATFYVKHNAITHFKDLCKYLWLNRGTESKKLFLECLEIADEKEFPDIKSIVSEYINYLFTAGAITKEEIMQAYALEYDMY

SEQ ID NO: 771 - protein, 525 aa, African swine fever virus; identical to SEQ ID NO: 716

SEQ ID NO: 772 - protein, 528 aa, African swine fever virus
MFSLQDLCRKNTFFLPDNFSKHTLYLLGLYWKGHGSIQRTMNDGVLIEHNLNLSINEALILAGEEGNNDVVQLLLLWEGNLHYAIIGALKTEKYGLICEYHSQIQDWHVLLPLIQDPETFEKCHDLSLECDLSCLLQHAVKYNMLSILVKYKEDLLNVLFRQQIQGLFILACEYRRIEILTWMGQNLPIPDPEPIFSIAVVTKDLEMFSLGYKIVFEYMENQGLFHLTQVVRMVMLNHHLGMVINKGLLPFVLETLKHGGNVNRALSYAVTQNKRKILDHVVRQKNIPHKTIERMLHLAVKKHAPRKTLNLLLSYINYKVKNVKKLLEHVVKYNSTLVIRILLEKKKNLLDATLTRYVKDSTYFQVKEFMQDFSISPEKFIKIAVREKRNVLIKGISEDIWENPAERIRNLKQIVCTIKYESGRQFLINIIHTIYQSYSLKPEEILKLATFYVKHNATTHFKDLCKYLWLNRGTESKKLFLECLEIADEKEFPDIKSIVSEYINYLFTAGAITKEEIMQVYALEYAMY

SEQ ID NO: 773 - DNA, 1587 bp, African swine fever virus
atgttctcccttcaggacctctgtcggaagaacaccttcttccttccagataattttagcaagcataccctgtatttgctggggttatactggaagggacatggatctatccaaagaacaatgaatgatggtgtactgatagagcataatcttaatctttccatcaatgaagccttaatccttgcaggagaagagggaaacaatgatgtagtacaactcttattgctatgggaaggaaatcttcattatgccatcataggagctttgaagactgagaaatatggcttaatatgtgagtaccatagccaaattcaggactggcatgttctcctccccttgattcaagatccagaaacattcgaaaaatgtcatgatttaagccttgaatgtgatctttcatgccttctccaacatgctgtaaaatataacatgctttctattcttgttaaatataaagaagatctattaaatgtactatttaggcaacaaattcaaggactatttattttagcatgtgaatatcggaggattgagattcttacgtggatgggtcaaaatctgccaattcctgatcctgagcctatttttagcattgctgttgtcacaaaagatttagaaatgttttccttagggtacaagattgtttttgaatacatggaaaatcaaggactatttcatttaacccaggtagttcgtatggttatgctaaatcatcaccttggcatggtaataaataaaggacttttaccctttgtgctggaaactttaaaacatggtgggaatgtaaatagagccttatcttatgctgtcacacaaaacaaaagaaagattttagaccatgttgttcgccaaaagaatataccccataaaaccattgaaagaatgttgcatctggctgtaaaaaagcatgctcccaggaaaactctgaacttgttactatcttacataaattacaaggtgaaaaatgttaaaaagttgttagaacatgtagtgaaatacaactctactcttgtgataagaatcttgttagaaaaaaagaaaaacctgctggatgctactttgacaagatatgtcaaagattctacatactttcaggtgaaagaatttatgcaagacttctccatcagcccagaaaaattcattaaaatagctgtgcgggaaaagaggaatgtgttgatcaagggtatttctgaagatatttgggaaaatcccgcggaaagaatcaggaatcttaagcagatagtgtgtaccataaaatatgaaagtggaagacaattcctgataaatatcattcacaccatttaccagagttattctttgaaacctgaagaaattcttaaactggcaacattttatgtcaaacacaatgcaaccacccattttaaagatctctgcaaatatctttggctgaacagaggaacagaaagtaagaaactgtttttagagtgcttggaaattgctgatgagaaggagtttcctgatattaaaagtattgtgagtgaatatattaactacttgtttactgcaggagctattaccaaggaagaaatcatgcaagtctatgctttggagtatgccatgtattaa

SEQ ID NO: 774 - protein, 527 aa, African swine fever virus; identical to SEQ ID NO: 724

SEQ ID NO: 775 - DNA, 1584 bp, African swine fever virus; identical to SEQ ID NO: 725

SEQ ID NO: 776 - protein, 9 aa, African swine fever virus
RAKHPNTYI

SEQ ID NO: 777 - protein, 9 aa, African swine fever virus
MRMLIRIEL

SEQ ID NO: 778 - protein, 9 aa, African swine fever virus
RRWLRVICL

SEQ ID NO: 779 - protein, 9 aa, African swine fever virus
ILDLIRLQY

SEQ ID NO: 780 - protein, 11 aa, African swine fever virus
ILQWHLLYETY

SEQ ID NO: 781 - protein, 10 aa, African swine fever virus
SSIGDTMELY

SEQ ID NO: 782 - protein, 13 aa, African swine fever virus
INYQRAPTWYSEV

SEQ ID NO: 783 - protein, 9 aa, African swine fever virus
ATQQLALNY

SEQ ID NO: 784 - protein, 9 aa, African swine fever virus
FSFGRTLVY

SEQ ID NO: 785 - protein, 1450 aa, African swine fever virus
MEAGYAEIAAVQFNIAGDNDHKRQGVMEVTISNLFEGTLPAEGGIYDARMGTTDHHYKCITCSHQRKQCMGHPGILQMHAPVLQPLFIAEIRRWLRVICLNCGAPIVDLKRYEHLIRPKRLIEAASSQTEGKQCYVCKAVHPKIVKDSEDYFTFWVDQQGKIDKLYPQIIREIFSRVTYDTVVKLGRSKNSHPEKLVLKAIQIPPISIRPGIRLGIGSGPQSFHDINNVIQYLVRKNLLIPKDLQIVRGQKIPLNIDRNLQTIQQLYYNFLLDSVSTTATQGGTGKRGIVMGARPAPSIMRRLPRKEGRIRKSLLGSQVWSISRSTICGNSDLHLDEVGYPISFARTLQVAETVQHYNINRLMPYFLNGKRQYPGCSRVYKQITQSVHDIEGLKQDFRLEVGDILYRDVVTGDVAFFNRQPSLERSSIGVHRIVVLENPKISTFQMNVSACAWYNADFDGDQMNLWVPWSVMSRVEAELLCSVRNWFISTKSSGPVNGQVQDSTVGSFLLTRTNTPMGKNVMNKLHAMGLFQTTQTDPPCFANYSPTDLLDGKSVVSMLLKQTPINYQRAPTWYSEVYAPYMHYNKQDISTQIRNGELIEGVLDKKAVGAGSSGGIYHLISRRYGPQQALKMIFATQQLALNYVRNAGFTVSTADMLLTPEAHQEVQEIINELLLESEEINNRLLHGDIMPPIGLTTHDFYEKLQLNALKFPDRILKPIMNSINPETNGLFQMVATGAKGSNPNMIHIMAGIGQIEINTQRIQPQFSFGRTLVYYPRFALEAQAYGFICNSYIAGLTSPEFIFGEMNGRFDLINKALSTSSTGYANRKAIFGLQSCIVDYYRRVSIDTRLVQQLYGEDGLDARQLETVRFETIMLSDQELEDKFKYTGIQSPLFEEEFSRLKKDRDKYRQIFLNVENFNFSQLLTDVRQVPVNVASIVKNILLSSTSGVLPFDEKSILQKYAMVKTFCKNLPYVFINNIQERLQTPIPVYLKRAAALMRMLIRIELATVKTLNITCEQMSAILDLIRLQYTQSLINYGEAVGILAAQSVSEPLTQYMLDSHHRSVAGGTNKSGIVRPQEIFSAKPVEAEQSSEMLLRLKNPEVETNKTYAQEIANSIELITFERLILQWHLLYETYSSTKKNVMYPDFASDVEWMTDFLENHPLLQPPEDIANWCIRLELNKTTMILKSISLESIINSLRAKHPNTYIMHSVENTASGIPIIIRIYLRESAFRRSTNTRMATDEKIAVNVVDKLLNSTIRGIPGIKNANVVKLMRHRVDAQGKLVRLDNIYAIKTNGTNIFGAMLDDNIDPYTIVSSSIGDTMELYGIEAARQKIISEIRTVMGDKGPNHRHLLMYADLMTRTGQVTSLEKAGLNAREPSNVLLRMALSSPVQVLTDAAVDSAVNPIYGIAAPTLMGSVPRIGTMYSDIIMDEKYITENYKSVDSMIDML

SEQ ID NO: 786 - protein, 1438 aa, African swine fever virus
FNIAGDNDHKRQGVMEVTISNLFEGTLPAEGGIYDARMGTTDHHYKCITCSHQRKQCMGHPGILQMHAPVLQPLFIAEIRRWLRVICLNCGAPIVDLKRYEHLIRPKRLIEAASSQTEGKQCYVCKAVHPKIVKDSEDYFTFWADQQGKIDKLYPQIIREIFSRVTYDTVVKLGRSKNSHPEKLVLKAIQIPPISIRPGIRLGIGSGPQSFHDINNVIQYLVRKNLLIPKDLQIVRGQKIPLNIDRNLQTIQQLYYNFLLDSVSTTATQGGTGKRGIVMGARPAPSIMRRLPRKEGRIRKSLLGSQVWSISRSTICGNSDLHLDEVGYPISFARTLQVAETVQHYNINRLMPYFLNGKRQYPGCSRVYKQITQSVHDIEGLKQDFRLEVGDILYRDVVTGDVAFFNRQPSLERSSIGVHRIVVLENPKISTFQMNVSACAWYNADFDGDQMNLWVPWSVMSRVEAELLCSVRNWFISTKSSGPVNGQVQDSTVGSFLLTRTNTPMGKNVMNKLHAMGLFQTTQTDPPCFANYSPTDLLDGKSVVSMLLRQTPINYQRAPTWYSEVYAPYMHYNKQDISTQIRNGELIEGVLDKKAVGAGSSGGIYHLISRRYGPQQALKMIFATQQLALNYVRNAGFTVSTADMLLTPEAHQEVQEIINELLLESEEINNRLLHGDIMPPIGLTTHDFYEKLQLNALKFPDRILKPIMNSINPETNGLFQMVATGAKGSNPNMIHIMAGIGQIEINTQRIQPQFSFGRTLVYYPRFALEAQAYGFICNSYIAGLTSPEFIFGEMNGRFDLINKALSTSSTGYANRKAIFGLQSCIVDYYRRVSIDTRLVQQLYGEDGLDARQLETVRFETIMLSDQELEDKFKYTGIQSPLFEEEFSRLKKDRDKYRQIFLNVENFNFSQLLTDVRQVPVNVASIVKNILLSSTSGVLPFDEKSILQKYAMVKTFCKNLPYVFINNIQERLQTPIPVYLKRAASLMRMLIRIELATVKTLNITCEQMSAILDLIRLQYTQSLINYGEAVGILAAQSVSEPLTQYMLDSHHRSVAGGTNKSGIVRPQEIFSAKPVEAEQSSEMLLRLKNPEVETNKTYAQEIANSIELITFERLILQWHLLYETYSSTKKNVMYPDFASDVEWMTDFLENHPLLQPPEDIANWCIRLELNKTTMILKSISLESIINSLRAKHPNTYIMHSVENTASGIPIIIRIYLRESAFRRSTNTRMATDEKIAVNVVDKLLNSTIRGIPGIKNANVVKLMRHRVDAQGKLVRLDNIYAIKTNGTNIFGAMLDDNIDPYTIVSSSIGDTMELYGIEAARQKIISEIRTVMGDKGPNHRHLLMYADLMTRTGQVTSLEKAGLNAREPSNVLLRMALSSPVQVLTDAAVDSAVNPIYGIAAPTLMGSVPRIGTMYSDIIMDEKYITENYKSVDSLIDML

SEQ ID NO: 787 - protein, 10 aa, African swine fever virus
TPALFKKHLY

SEQ ID NO: 788 - protein, 9 aa, African swine fever virus
VVTPKHLTY

SEQ ID NO: 789 - protein, 16 aa, African swine fever virus
YADRYALFQKLTPALF

SEQ ID NO: 790 - protein, 419 aa, African swine fever virus
MLNQFPGQYSNNIFCFPPIESETKSGKKASWIICVQVVQHNTIIPITDEMFSTDVKDAVAEIFTKFFVEEGAVRISKMTRVTEGKNLGKKNATTVVHQAFKDALSKYNRHARQKRGAHTNRGMIPPMLVKYFNIIPKTFFEEETDPIVQRKRNGVRAVACQQGDGCILLYSRTEKEFLGLDNIKKELKQLYLFIDVRVYLDGELYLHRKPLQWIAGQANAKTDSSELHFYVFDCFWSDQLQMPSNKRQQLLTNIFKQKEDLTFIHQVENFSVKNVDEALRLKAQFIKEGYEGAIVRNANGPYEPGYNNYHSAHLAKLKPLLDAEFILVDYTQGKKGKDLGAILWVCELPNKKRFVVTPKHLTYADRYALFQKLTPALFKKHLYGKELTVEYAELSPKTGIPLQARAVGFREPINVLEII

SEQ ID NO: 791 - protein, 419 aa, African swine fever virus
MLNQFPGQYSNNIFCFPPIESETKSGKKASWIICVQVVQHNTIIPITDEMFSTDVKDAVAEIFTKFFVEEGAVRISKMTRVTEGKNLGKKNATTVVHQAFKDALSKYNRHARQKRGAHTNRGIIPPMLVKYFNIIPKTFFEEETDPIVQRKRNGVRAVACQQGDGSILLYSRTKKEFLGLDNIKKELKQLYLFIDVRVYLDGELYLHRKPLQWIAGQANAKTDSSELHFYVFDCFWSDQLQMPSNKRQQLLTNIFKQKEDLTFIHQVENFSVKNVDEALRLKAQFIKEGYEGAIVRNANGPYEPGYNNYHSAHLAKLKPLLDAEFILVDYTQGKKGKDLGAILWVCELPNKKRFVVTPKHLTYADRYALFQKLTPALFKKHLYGKELTVEYAELSPKTGIPLQARAVGFREPINVLEII

SEQ ID NO: 792 - protein, 11 aa, African swine fever virus
TLINPDDEYLY

SEQ ID NO: 793 - protein, 9 aa, African swine fever virus
YLYEIEIEY

SEQ ID NO: 794 - protein, 21 aa, African swine fever virus
QFQPSDFPLAFLYYHPDTSSF

SEQ ID NO: 795 - protein, 10 aa, African swine fever virus
YMDPFSFEEL

SEQ ID NO: 796 - protein, 868 aa, African swine fever virus
MASLDNLVARYQRCFNDQSLKNSTIELEIRFQQINFLLFKTVYEALVAQEIPSTISHSIRCIKKVHHENHCREKILPSENLYFKKQPLMFFKFSEPASLGCKVSLAIEQPIRKFILDSSILVRLKNRTTFRVSELWKIELTIVKQLMGSEVSAKLAAFKTLLFDTPEQQTTKNMMTLINPDDEYLYEIEIEYTGKPESLTAADVIKIKNTVLTLISPNHLMLTAYHQAIEFIASHILSSEILLARIKSGKWGLKRLLPQVKSMTKADYMKFYPPVGYYVTDKADGIRGIAVIQDTQIYVVADQLYSLGTTGIEPLKPTILDGEFMPEKKEFYGFDVIMYEGNLLTQQGFETRIESLSKGIKVLQAFNIKAEMKPFISLTSADPNVLLKNFESIFKKKTRPYSIDGIILVEPGNSYLNTNTFKWKPTWDNTLDFLVRKCPESLNVPEYAPKKGFSLHLLFVGISGELFKKLALNWCPGYTKLFPVTQRNQNYFPVQFQPSDFPLAFLYYHPDTSSFSNIDGKVLEMRCLKREINHVSWEIVKIREDRQQDLKTGGYFGNDFKTAELTWLNYMDPFSFEELAKGPSGMYFAGAKTGIYRAQTALISFIKQEIIQKISHQSWVIDLGIGKGQDLGRYLDAGIRHLVGIDKDQTALAELVYRKFSHATTRQHKHATNIYVLHQDLAEPAKEISEKVHQIYGFPKEGASSIVSNLFIHYLMKNTQQVENLAVLCHKLLQPGGMVWFTTMLGEQVLELLHENRIELNEVWEARENEVVKFAIKRLFKEDILQETGQEIGVLLPFSNGDFYNEYLVNTAFLIKIFKHHGFSLVQKQSFKDWIPEFQNFSKSLYKILTEADKTWTSLFGFICLRKN

SEQ ID NO: 797 - protein, 9 aa, African swine fever virus
YQLDLFTAL

SEQ ID NO: 798 - protein, 174 aa, African swine fever virus; identical to SEQ ID NO: 167

SEQ ID NO: 799 - protein, 16 aa, African swine fever virus
VVIMAIMLYYFWWMPR

SEQ ID NO: 800 - protein, 61 aa, African swine fever virus
MALDGSSGGGSNVETLLIVAIIVVIMAIMLYYFWWMPRQQKKCSKAEECTCNNGSCSLKTS

SEQ ID NO: 801 - protein, 10 aa, African swine fever virus
AAYVGKGTTI

SEQ ID NO: 802 - protein, 9 aa, African swine fever virus
NSTIHTATI

SEQ ID NO: 803 - protein, 9 aa, African swine fever virus
VIKKFQQTI

SEQ ID NO: 804 - protein, 10 aa, African swine fever virus
AAYVGKGTTI

SEQ ID NO: 805 - protein, 9 aa, African swine fever virus
TIMVRNEQL

SEQ ID NO: 806 - protein, 18 aa, African swine fever virus
IEFNTYYEILYAWLPYRR

SEQ ID NO: 807 - protein, 8 aa, African swine fever virus
NTYYEILY

SEQ ID NO: 808 - protein, 8 aa, African swine fever virus
ILYAWLPY

SEQ ID NO: 809 - protein, 8 aa, African swine fever virus
REHAVLKL

SEQ ID NO: 810 - protein, 11 aa, African swine fever virus
RIIMETAIVRY

SEQ ID NO: 811 - protein, 9 aa, African swine fever virus
REMFTRIEL

SEQ ID NO: 812 - protein, 11 aa, African swine fever virus
SIAENVFKTHY

SEQ ID NO: 813 - protein, 9 aa, African swine fever virus
KTMPVEFYY

SEQ ID NO: 814 - protein, 10 aa, African swine fever virus
SLANHTVKYY

SEQ ID NO: 815 - protein, 8 aa, African swine fever virus
YVADHMFY

SEQ ID NO: 816 - protein, 1192 aa, African swine fever virus
MEAFEISDFKEHAKKKSMWAGALNKVTISGLMGVFTEDEDLMALPIHRDHCPALLKIFDELIVNATDHERACHSKTKKVTYIKISFDKGVFSCENDGPGIPIAKHEQASLIAKRDVYVPEVASCFFLAGTNINKAKDCIKGGTNGVGLKLAMVHSQWAILTTADGAQKYVQQINQRLDIIEPPTITPSREMFTRIELMPVYQELGYAEPLSETEQADLSAWIYLRACQCAAYVGKGTTIYYNDKPCRTGSVMALAKMYTLLSAPNSTIHTATIKADAKPYSLHPLQVAAVVSPKFKKFEHVSIINGVNCVKGEHVTFLKKTINEMVIKKFQQTIKDKNRKTTLRDSCSNIFVVIVGSIPGIEWTGQRKDELSIAENVFKTHYSIPSSFLTSMTRSIVDILLQSISKKDNHKQVDVDKYTRARNAGGKRAQDCMLLAAEGDSALSLLRTGLTLGKSNPSGPSFDFCGMISLGGVIMNACKKVTNITTDSGETIMVRNEQLTNNKVLQGIVQVLGLDFNCHYKTQEERAKLRYGCIVACVDQDLDGCGKILGLLLAYFHLFWPQLIIHGFVKRLLTPLIRVYEKGKTMPVEFYYEQEFDAWAKKQTSLVNHTVKYYKGLAAHDTHEVKSMFKHFDNMVYTFTLDDSAKELFHIYFGGESELRKRELCTGVVPLTETQTQSIHSVRRIPCSLHLQVDTKAYKLDAIERQIPNFLDGMTRARRKILAGGVKCFASNNRERKVFQFGGYVADHMFYHHGDMSLNTSIIKAAQYYPGSSHLYPVFIGIGSFGSRHLGGKDAGSPRYISVQLASEFIKTMFPAEDSWLLPYVFEDGQRAEPEYYVPVLPLAIMEYGANPSEGWKYTTWARQLEDILALVRAYVDKDNPKHELLHYAIKHKITILPLRPSNYNFKGHLKRFGQYYYSYGTYDISEQRNIITITELPLRVPTVAYIESIKKSSNRMTFIEEIIDYSSSETIEILVKLKPNSLNRIVEEFKETEEQDSIENFLRLRNCLHSHLNFVKPKGGIIEFNSYYEILYAWLPYRRELYQKRLMREHAVLKLRIIMETAIVRYINESAELNLSHYEDEKEASRILSEHGFPPLNHTLIISPEFASIEELNQKALQGCYTYILSLQARELLIAAKTRRVEKIKKMQARLDKVEQLLQESPFPGASVWLEEIDAVEKAIIKGRNTQWKFH

SEQ ID NO: 817 - protein, 1192 aa, African swine fever virus
MEAFEISDFKEHAKKKSMWAGALNKVTISGLMGVFTEDEDLMALPIHRDHCPALLKIFDEIIVNATDHERACHNKTKKVTYIKISFDKGVFSCENDGPGIPIAKHEQASLIAKRDVYVPEVASCHFLAGTNINKAKDCIKGGTNGVGLKLAMVHSQWAILTTADGAQKYVQHINQRLDIIEPPTITPSREMFTRIELMPVYQELGYAEPLSETEQADLSAWIYLRACQCAAYVGKGTTIYYNDKPCRTGSVMALAKMYTLLSAPNSTIHTATIKADAKPYSLHPLQVAAVVSPKFKKFEHVSVINGVNCVKGEHVTFLKKTINEMVVKKFQQTIKDKNRKTTLRDSCSNIFIVIVGSIPGIEWTGQRKDELSIAENVFKTHYSIPSSFLTSMTKSIVDILLQSISKKDNHKQVDVDKYTRARNAGGKRAQDCMLLAAEGDSALSLLRTGLTLGKSNPSGPSFDFCGMISLGGVIMNACKKVTNITTDSGETIMVRNEQLTNNKVLQGIVQVLGLDFNCHYKTQEERAKLRYGCIVACVDQDLDGCGKILGLLLAYFHLFWPQLIIHGFVKRLLTPLIRVYEKGKTMPVEFYYEQEFDAWAKKQTSLANHTVKYYKGLAAHDTHEVKSMFKHFDNMVYTFTLDDSAKELFHIYFGGESELRKRELCTGVVPLTETQTQSIHSVRRIPCSLHLQVDTKAYKLDAIERQIPNFLDGMTRARRKILAGGVKCFASNNRERKVFQFGGYVADHMFYHHGDMSLNTSIIKAAQYYPGSSHLYPVFIGIGSFGSRHLGGKDAGSPRYISVQLASEFIKTMFPAEDSWLLPYVFEDGQRAEPEYYVPVLPLAIMEYGANPSEGWKYTTWARQLEDILALVRAYVDKDNPKHELLHYAIKHKITILPLRPSNYNFKGHLKRFGQYYYSYGTYVISEQRNIITITELPLRVPTVAYIESIKKSSNRMTFIEEIIDYSSSETIEILVKLKPNSLNRIVEEFKETEEQDSIENFLRLRNCLHSHLNFVKPKGGIIEFNTYYEILYAWLPYRRELYQKRLMREHAVLKLRIIMETAIVRYINESAELNLSHYEDEKEASRILSEHGFPPLNHTLIISPEFASIEELNQKALQGCYTYILSLQARELLIAAKTRRVEKIKKMQARLDKVEQLLQESPFPGASVWLEEIDAVEKAIIKGRNTQWKFH

SEQ ID NO: 818 - protein, 9 aa, African swine fever virus
AKNIRILFL

SEQ ID NO: 819 - protein, 8 aa, African swine fever virus
RRFRFVSL

SEQ ID NO: 820 - protein, 11 aa, African swine fever virus
LTARFARALKY

SEQ ID NO: 821 - protein, 9 aa, African swine fever virus
YQFLIYTAF

SEQ ID NO: 822 - protein, 706 aa, African swine fever virus
MSCVHNNTSFPVQIEAYLKEVYEKYKELQESKDTSLTARFARALKYYQFLIYTAFSDPKFGIGQGENTRGLLIYHQMGMGKTILSLSLAISLSHIYNPILIAPKSLHSNFQQSLLKLIKLLYPETTDHSKELQKISRRFRFVSLDAYNMGQQIIKAGGSLNGCLLIVDEAHNLFRGIINSANDKTNARQLYNNIMQAKNIRILFLTGTPCSKDPFEMVPCFNMLSGRILLPLHYERFYTAYVNKTTNSPLNADKLLNRLVGMISYAGNQNELNKLFPTELPLIIEKVEMSPEQYRQYLLARDVENAEKHASSGMYEKINAAALCLPGSEQESGSSYYVRSRMISIFASEMLTVKEDEKLSEAVQQLPKEAFTENSSPKIVRMLKNIKTSPGPVLIYSQFVELGLHVVARFLEIEGYQCLQPLKVLEEGHNTILLHKDGKDLMVKNFAEDGPTHTLVLSSKITRFTLITGKILSKERDMIQQVWNSPLNIHGEVIKILLVSKTGAEGLDLKYGRQVHILEPYWDKAREDQVKARIIRIGSHDALPPEEKTVQPFLYIAVANQKMFYSIPEGSQEQKTIDERFHERGLEKSHLNSAFRDLLKRAAIECAFNGESGCLMCQPTNALLFHENFERDLRLPNPCQPLVKAEVKAYSISYEGKQFFYQKNKDVGLGYTFYEYNPIIKAYIEIKPSNPLYIKLIKHVQAGTTA

SEQ ID NO: 823 - protein, 706 aa, African swine fever virus
MSCVHNNTSFPVQIEAYLKEVYEKYKELQESKDTSLTARFARALKYYQFLIYTAFSDPKFGIGQGENTRGLLIYHQMGMGKTILSLSLAISLSHIYNPILIAPKSLHSNFQQSLLKLIKLLYPETTDHSKELQKISRRFRFVSLDAYNMGQQIIKAGGSLNGCLLIVDEAHNLFRGIINSANDKTNARQLYNNIMQAKNIRILFLTGTPCSKDPFEMVPCFNMLSGRILLPLHYERFYTAYVNKTTNSPLNADKLLNRLVGMISYAGNQNELNKLFPTELPLIIEKVEMSPEQYRQYLLARDVENAEKHASSGMYEKINAAALCLPGSEQESGSSYYVRSRMISIFASEMLTVKEDEKLSEAVQQLPKEAFTENSSPKIVRMLKNIKTSPGPVLIYSQFVELGLHVVARFLEIEGYQCLQPLKVLEEGHNTILLHKDGKDLMVKNFAEDGPTHTLVLSSKITRFTLITGKILSKERDMIQQLWNSPLNIHGEVIKILLVSKTGAEGLDLKYGRQVHILEPYWDKAREDQVKARIIRIGSHDALPPEEKTVQPFLYIAVANQKMFYSIPEGSQEQKTIDERFHERGLEKSHLNSAFRDLLKRAAIECAFNGESGCLMCQPTNALLFHENFERDLRLPNPCQPLVKAEVKAYSISYEGKQFFYQKNKDVGLGYTFYEYNPIIKAYIEIKPSNPLYIKLIKHVQAGTTA

SEQ ID NO: 824 - protein, 9 aa, African swine fever virus
KKINTIHKL

SEQ ID NO: 825 - protein, 10 aa, African swine fever virus
NKLQDISKVL

SEQ ID NO: 826 - protein, 9 aa, African swine fever virus
PSMKKINTI

SEQ ID NO: 827 - protein, 383 aa, African swine fever virus
MASILALDGLYAEVPKFLPEALREGCAGKNPLSFYIQQILNLMGCDGNEYHVLFTGSSEEANTHMIMAAVRRHLLRTQQRPHVIIGAAEPPSVTECVKALAQEKRCVYTIIPLKNFEIDPVAVYDAIQSNTCLACISGTNAVVKTFNKLQDISKVLKGIPLHSEVSELVYQGCIKQNPPADSFSINSLYGFLGVGVLGMKKKVMQGLGPLIFGGGLRGGSPNIPGIHAMYRTLTQQRPSMKKINTIHKLFMKTLKKHQHVYLPIGGVSAEDTSAENISTKDIPVEGPKELPGYILFSVGRRAEELQKKIFTKFNIKVGRIVDLQEILFRIKIPQKYWETLLFIQLRDNLTKEDIKRVMVVLMHLDTITPRGSLPPPSYSSSFS

SEQ ID NO: 828 - protein, 383 aa, African swine fever virus
MASILTLDGLYAEVPKFLPEALREGCAGKNPLSFYIQQILNLMGCDGNEYHVLFTSSSEEANTHMIMAAVRRHLLRTQQRPHVIIGAAEPPSVTECVKALAQEKRCVYTIIPLKNFEIDPVAVYDAIQSNTCLACISGTNAVVKTFNKLQDISNVLKGIPLHSEVSDLVYQGCIQQNPPADSFSINSLYGFLGVGVLGMKKKVMQGLGPLIFGGGLRGGSPNIPGIHAMYKTLTQQRPSMKKNKYNTYAVHENFKKHQHVYLPIGGVSAEDTSAENISTKDMPVEGPKGLPGYILFSVGRRAEELQKKIFTKFNIKVGRVVDLQEILFRIKIPQKYWETLLFIQLRDNLTKEDIKRVMVVLMHLDTITPRGSLPPPSHSSSFS

SEQ ID NO: 829 - protein, 19 aa, African swine fever virus
ALSQAHSASIILLTYGYGR

SEQ ID NO: 830 - protein, 9 aa, African swine fever virus
SIILLTYGY

SEQ ID NO: 831 - protein, 13 aa, African swine fever virus
ETAFTLQGEYIYF

SEQ ID NO: 832 - protein, 10 aa, African swine fever virus
MVYTTRPVSL

SEQ ID NO: 833 - protein, 509 aa, African swine fever virus
MEAIISFAGIGINYKKLQSKLQHDFGRVLKALTVTARALPGQPKHIAIRQETAFTLQGEYIYFPILLQKQFEMFNMVYTTRPVSLRALPCVETEFPLFNYQQEMVDKIHKKLLSPYGRFYLHLNTGLGKTRIAISIIQKLLYPTLVIVPTKAIQIQWIDELTLLLPHLRVAAYNNAACKKKDMTSKEYDVIVGIINTLRKKPEQFFEPFGLVVLDEAHELHSPENYKIFWKIQLSRILGLSATPLDRPDGMDKIIIHHLGQPQRTVSPTTTFSGYVREIEYQGHPDFVSPVYINEKVSAIATIDKLLQDPSRIQLVVNEAKRLYSLHTAEPHKWGTDEPYGIIIFVEFRKLLEIFYQALSKEFKDVQIIVPEVALLCGGVSNTALSQAHSASIILLTYGYGRRGISFKHMTSIIMATPRRNNMEQILGRITRQGSDEKKVRIVVDIKDTLSPLSSQVYDRHRIYKKKGYPIFKCSASYQQPYSSNEVLIWDPYNESCLACTTTPPSPSK

SEQ ID NO: 834 - protein, 298 aa, African swine fever virus
MSRPEQQLKKMLKNPQAQYAFYPTAKVERISTTQHMYFIATRPMFEGGRNNVFLGHQVGQPIIFKYVSKKEIPGNEVIVLKALQDTPGVIKLIEYTENAMYHILIIEYIPNSVDLLHYHYFKKLEETEAKKIIFQLILIIQNIYEKGFIHGDIKDENLIIDINQKIIKVIDFGSAVRLDETRPQYNMFGTWEYVCPEFYYYGYYYQLPLTVWTIGMVAVNLFRFRAENFYLNDILKRENYIPENISETGKQFITECLTINENKRLSFKSLVSHPWFKGLKKEIQPISELGVDYKNVIT

SEQ ID NO: 835 - protein, 11 aa, African swine fever virus
GTWEYVCPEFY

SEQ ID NO: 836 - protein, 26 aa, African swine fever virus
GTWEYVCPEFYYYGYYYQLPLTVWTI

SEQ ID NO: 837 - protein, 9 aa, African swine fever virus
YVCPEFYYY

SEQ ID NO: 838 - protein, 11 aa, African swine fever virus
YVCPEFYYYGY

SEQ ID NO: 839 - protein, 10 aa, African swine fever virus
FYYYGYYYQL

SEQ ID NO: 840 - protein, 10 aa, African swine fever virus
YQLPLTVWTI

SEQ ID NO: 841 - protein, 11 aa, African swine fever virus
NLFRFRAENFY

SEQ ID NO: 842 - protein, 10 aa, African swine fever virus
AMYHILIIEY

SEQ ID NO: 843 - protein, 298 aa, African swine fever virus; identical to SEQ ID NO: 834

SEQ ID NO: 844 - protein, 9 aa, African swine fever virus
YSLNNWARY

SEQ ID NO: 845 - protein, 9 aa, African swine fever virus
QAFEHLYAF

SEQ ID NO: 846 - protein, 183 aa, African swine fever virus; identical to SEQ ID NO: 169

SEQ ID NO: 847 - protein, 10 aa, African swine fever virus
SMMDFERVHY

SEQ ID NO: 848 - protein, 9 aa, African swine fever virus
TLQRWAIKY

SEQ ID NO: 849 - protein, 273 aa, African swine fever virus; identical to SEQ ID NO: 171

SEQ ID NO: 850 - protein, 11 aa, African swine fever virus
NEYWAIHLFFI

SEQ ID NO: 851 - protein, 8 aa, African swine fever virus
SQFWNYTM

SEQ ID NO: 852 - protein, 69 aa, African swine fever virus; identical to SEQ ID NO: 173

SEQ ID NO: 853 - protein, 209 aa, African swine fever virus
MRGILITIEGINGVGKSTQAMRLKKALECMDYNAVCIRFPNPDTTTGGLILQVLNKMTEMSSEQLHKLFTKHHSEFSAEIAALLKLNFIVIVDHYIWSGLAYAQADGITIETKNIFKPDYTFFLSSKKPLNEKPLTLQRLFETKEKQETIFTNFTIIMNDVPKNRLCIIPATLNKEIIHTMILTKTIKVFDNNSCLNYIKMYDDKYLNV

SEQ ID NO: 854 - protein, 236 aa, African swine fever virus
MRGILIAIEGINGVGKSTQAMKLKETLECMDYNAICIHFPNPDTTTGDLILQVLNKTIEMSSEQLHKLFTKHRSEFIAEIAVLLKLNYIVIVDRYIWSGLVYAQADGITIETKNTFKPDYTFFLSSKKPLNEKPLTLQRLFETKEKQETIFTNFTIIMDDVPKNRFCIIPATLNKEIIHMIILTKTLKVFDNNSCLNYIKMYDDKYLNVQDLNLFDFDWQKYIEDNNDKEEYDFIV

SEQ ID NO: 855 - DNA, 6594 bp, Artificial Sequence
  Expression plasmid pCMV
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccacatgcagatctttgtgaaaaccctgaccgggaaaaccattaccctggaagtggaaccctccgacaccattgaaaacgtgaaggctaagatccaggacaaggagggcatccccccagaccagcagaggctgatcttcgccggcaagcagctggaggacggcagaaccctgagcgactacaacatccagaaggagtccaccctgcacctggtgctgaggctgaggggagctgcctactgcagcaactactccaccagcatctacaacatcaccaacaactgctccctgaccatcttcccccacaacgacgtgttcgccgcctacacctaccaggtggtgtggaaccagatcatcaactacgccgcctacatctacctgaacatcaacgacaccttcgtgaagtacaccaacgagagcatcctggagtacaactgggccgcctaccgctaccagtacaacaccccaatctactacatgaggccatccacccagccactggctgcttacgagaccaccctgatcaactgcacctacctgaccctgtccagcaactacttctacaccttcttcaagctgtacgctgcttaccacgctgacgacctgctgcaggccctgcagcaggctaaggccgagaagaacttctccagcgtgttcagcctggactgggacaagctgaggaccgccaagagaaacaccaccgtgaagtacgtgaccgtgaacgtggccgcctactgcatcagcaacatgggcatctccttccccctgtgcctggagatgggcgtggtgaaggtgttcgagaagaacaacggcatcgacgtgaactccatctacggcagcgacgacatctccaccctggctgcctacaagctgttcaccaagcaccgcagcgagttcatcgccgagatcgccgtgctgctgaagctgaactacatcgtgatcgtggaccgctacatctggtccggactggtgtacgctcaggctgacggcatcaccatcgagaccaagaacaccttcaagcccgactacaccttcttcctgtccagcaagaagccactgaacgagaaggccgcctacaaggagatcatccacatgatcatcctgaccaagaccctgaaggtgttcgacaataactcctgcctcaactatatcaagatgtacgatgacaaatactgaggatccactagtccagtgtggtggaattctgcagatatccagcacagtggcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctgggtccgatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 856 - DNA, 11072 bp, Artificial Sequence
  Expression plasmid pCMV
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttgccaccatgcagattttcgtgaagaccctgaccgggaagaccattaccctggaagtggaaccatccgataccattgagaacgtgaaggctaagatccaggacaaggagggcatccccccagaccagcagcggctgatcttcgctggcaagcagctggaggacggaaggaccctgtccgactacaacatccagaaggagagcaccctgcacctggtgctgaggctgagaggagctgcttacaccggagctgcttaccactccatcgtgaccgagtaccagtaccaggtgaagggctacatcctgggcgtgaagcagaacaagaagctgtacgagaagatgctggacagcttctacaagtacttcgccgcctacttctccaacttcgtgaccaccatcgtggacagcttcatccccaaggagtacagccagtccatcagcctggagaagaaggagtccatcctggagctgctgctgtgcgactacatcagcaacctgggcaccttcatcaccaccgagaagatgctgcccttcatcatcaagaaccggaaggagaactaccacaaggtgaccaaggagatgcaggactactccctgaccttcctgctgaagaagagaatggagctgtacaacaagttcgctgcttacaggcagtccgagtaccgccggctggtgcagctgctgtaccagcagatccagagaagctccaccagcaagagctcctaccccctgaccaagttcatcgaaaccctgccctccgagcacttcagcaacgaggagtaccagaaggaaacccccgccgaccagaaggaggtggtggagatggagctgctgcgcaagcaggagctgctgaccagccaggagctgacctccaagagccccaacaacgctgcttacgccttcttcccatgcgacccatacgcttccccattccccagcatcaagggcctgcagctgcacaacgcccagctgttcgtgcagaacttccagaaccccaacaccccctactcccggctgctgctgaactggcagaccggaaccggcaagagcatcgctgctatcgccatcgccaggcagttcatgaatcactacatgaacttcatcgagaacgccccctggatcttcgtggtggccgcctacaggatcttcgccggcaagatgctgtcctacaaggacgaaaccctgccctacctgcacttcatcgagtgccccatgagcgagtaccagctggaaaccctgaagcagctgggccccgaccccaagatcagctccaacgcctactccatctacgacatggtgttccccaaccccaagttcagcaagcagaccgagccaaaggcctacggcctgttcgctgcctacgtgctggacatcgaaacctacatcagggacttccagccaccagctatgcactccatcaggatcaccaagtacctggagcacagccagaccaaggagcccttccaggtgctgtacgagaagttccagaaggacttccaggacgagcccatggagcaggtgctgatccactaccccgcctccttccactacaccatgctggaggccctgatcatcgacaacctggctggaatgggcgccctggtggaggtgtacgccgcctacagccaggtggacctgaaccaggccatcaacaccttcatgtactactactacgtggcccagatctactccaacctgacccacaacaagcaggagttccagagctacgaggagaactacgccaccatcctgggcgacgctatcgctggccggctgatgcagctggctgcttacgctaccgtgtccgccatcgagctggagtacgacgtgaagaggagattctacagggccctggagggcctggacctgtacctgaagaacatcaccaagaccttcgtgaacaacatcgctgcttacttcaccgacaacgctccagctggacactactacgagaaggtggccgccgagatccagcagggcagatccgtgggcaccctgcggcccgtgagggctagccaggccaagaacatccgggacctgatcggcaggtccctgagcaacttccaggccctgaaggctgcttacaccgctgaggaggctgctcagcgggtgtacctgtccaccgtgagggtgaacgacgctctgagcaccagatgggaaaccgaggacgtgttcttcaccttcatgctgaagagcatggccgccaagatcttcatcgtgctgggcatctacgacatgttcgagagggctgcttacgaagtgatcccagaggccgccgagctgtacttcagactgccccgcctggccgagttctaccagaagctgttctccttcagggacgagaacgtgcagatcagcatgctgccagagctggctgcttacggcctgtcccagcacctgatcagcaccctgaccgagatccccatctacctgaaggagaactaccgcgccaacctgcccctgttcaacaaggctgcttacgctggcatccagaggggacgggagaggtggggccaccccatgtccatctacatcaaccaggccctgcacgagatcgtgcggaccatcaggctggctgaaaccgtgcgcggcctggctgcttacaaggagttcatcaccctgctgaaccaggccctggcttccacccagctgtacaggagcatccagcagctgttcctgaccatgtacaagctggaccccatcggcttcatcaactacatcaagaccagcaagcaggagtacctgtgcctgctgatcaaccccaagctggtgaccaagttcctgaagatcacctccttcaagatctacatcaacttcagactgaagaccttctacatcagccccaacaagtacaacaacttctacgccgcctacgccctggtggacgagatctactccaccctgaagggcagcaacgacatcaagaacatcagactgatcgacttcctgttcaccctgaaggacttcgtgaaccacgtgcgcgctgagcagtccaagctgcccgacctgagcatgcccatcgaggcctacatcgccgcctacctgctgaccgagatcctgctggaccccatgtacgactacgctgctaccgtggctagaatcgacggaagcatccccatgcacaagccaaggaccccaaaggaggctgagtacgagttcaagaccgtgatcggaaggaccccagctgagctgctgtcccagaaggagttctacgacaagatctacaccagcaagtacagacccgacttcacccagctgacccgcctgaacgatatctacgccgcctactccatcatggacagaagcgagatcgtggcccgcgagaaccccgtgatcacccagagagtgaccaacctgctgcagaccaacgcccccctgctgttcatgcccatcgacatccacgaggtgcgctacggcgcctacaccctgttcatgtacggctccctggagaacggctacaaggccgcctacagcctgctgaccgccgagaacatcgtgtacgagagactggaaaccctgacccagcggcccgtgatgggctacagggagaaggagaaggagttcgccccctacatccgcatcttcttcaagtccctgtacgagcgccggaaggccatcacctacctgaacaacatgggctacaacaccgccgccgacgacaccacctgctactacagaatggtgagccgcgagctgaagctgcccctgacctcctggatccagctgcagcactacagctacgagcccagaggcctggtgcaccgcttctccgtgaccccagaggacctggtgagctaccagaacgacggccccaccgaccactccatcgtgatggcctacgacatcgaaacctactcccccgtggccgcctacagcctgtaccagaacctgctggagagcgtgtacttcgccgtggaaaccatccacctgaagcagcagatcgagttcctgaacttcggcatgaagtgctaccggcacttctacaacaagatcaagctgctgaacgactacctggcccccaagaagaagatcttccaggacagatggcgcgtgctgaacaagctgtacgtgctggagaagaagcacaagctggccgcctacaacaagatcgagagctccgtgcacctgctgaggaagaacttcaacacctactactccgactacgtgggcagcggctacaaccccaccatcatcatggagcagtacatcaaggacatctcccaggacagcaagaacatctcccccagaatcagctaccagttccgcaccatcatcaagtactaccgggacatgatcgccaccaggcaccagaccatggacccacaggtgctgaacctggtggctgcctaccagcagatccaggagatcctgtacctgctgcggatgcacatctacgaaaccaacctgtacctgaagcaggagctgagcagactgatctaccccaaccgccagctgtccttcgtgctgctgatgcccctgagcctgctgagaaactgggacgacatcgagtacgccgcctacaagctgaacaagaagcagcgccactccttctacgaggtgctggtgaccagcgaaaccctgaacaactacgagaacctgtccaagaacatcctgaacaccctgatgttcgccgtgcggtacgtgttcaagccaaccccaaactacgctgcttacaggctgatgaacttcatctacgataggtgctactaccacatgcagggcgaggagatcttcagcctggccaggttctacgctatccaccacgctccaaagctggctgcttacgccaccaacatcaacatcgtgaacaagtacatcggcaacctgttcgtgatgggcgtgctgtccaagaaggagatcctgcaggactacccctccatctacagcaagcagtacatggccgcctacttcctgctgtggaagggcagcctgcagtacgctatcatcggcgccctggagggccggcagtacgacctgatccagaagtactacgccgcctacgtgacctgcaccttccagtgcctgttccagcacgccatccgggacaacatgctgcctatcttccagaagtacgccgcctacgcctccaggaagaccttcaacctgctgctgagctccatcaactactgcgtgaaccccttcgtgaagaaggccgcctacatggtgaacaccatgaaccacaggaacggcaagaacctgctgatgtacaacatccacaacatcaccggctacacctacctgaacaccaaggaggccttcaacctgaccagattctacgccgtgcacaacgccacctgcctgttcaaggagatgtgcaagtcctgcttcgtgcacgacaagatccagctgagggagctggctgcttacagggagatgttcaccaggatcgagctgatgcccgtgtaccaggagctgggatacgctgagccactgtccgaaaccgagcaggccgacctgagcgcctggatctacctgagagcttgccagtgcgctgcttacgtgggcaagggaaccaccatctactacgccgcctacaccaccgacagcggcgaaaccatcatggtgcgcaacgagcagctgaccaacaacaaggtgctgcagggcatcgtgcaggtgctgggactcgacttcaactgtcattacaagacccaggaggaaagagccaaactgagatactgagaattctgcagatatccagcacagtggcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctgggtccgatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 857 - DNA, 1584 bp, African swine fever virus
atgttctctctgcaggacttgtgtcgcaagaataccttcttcctgccttcagacttcagtaagcacaccttgcatctgcttggcctctattggaagggccatggatcaatccagcgcatcaagaatgacggtgtgctgatcgaacacgatctgacactctccattaacgaagccctgattctggcaggcgaggaaggcaataatgaggtcgttaaactgctcttgctttgggaagggaatctccactatgcgatcattggtgccctgagaacggagaactacaatctggtgtgtgagtatcacagccagatccaggattggcacgtgttgctgccactgatccaagaccccgagactttcgagaagtgccatgacctgagtcttgagtgcgacctgtcttgtctcctgcaacatgctgtgaaatacaacatgctgagcatcctcgtcaagtataaggaggatctcctgaacgtgctgtttcgccagcagattcagggcctgtttatcctggcttgtgagaaccgcaaactggagattctgacttggatggggcagaatctgcccattcctgatcccgaacccatcttcagcatcgccgttgtcaccaaagacctggagatgttctccttgggctacaaaatcgtgtttgagtatatggaaaaccaaggactgcacctcactcaggtagtgcggatggtgatgctgaatcaccactttggcatggtgataaacaaaggactgctgccctttgtcctggaaatcctgaactatggtggaaacgtgaaccgggctttgagctacgccgtaacgcagaataagcgcaaaatcctggatcacgttgttagacagaagaacatcccgcacaaaaccatagagaggatgctgcatttggccgtaaagaagcatgctcctagaaagaccctgaatctcctgctgagctacatcaactacaaagtgaagaacgtgaagaaacttctggagcacgtcgtcaagtacaattccacactggtcatacggctgctgctggagaagaagaagaacctccttgacgcgacacttacccgatacgtgaaggattcaacctactttcaggtgaaagagtttatgcaggatttctccatttcccctgagaagttcatcaagatcgcggttagggagaagaggaacgtcctcataaaggggattagtgaggacatttgggaaaacccagctgaacgaatcaggaacttgaagcagattgtgtgcaccatcaaatatgaatccgggagacagttcctgattaacatcattcacactatctaccaaagctactctctcaaaccggaagaaatcctcaaactcgccaccttctatgtcaaacacaatgcaacaacccatttcaaagatctgtgcaaatacctttggcttaatcgccggacagagagcaagaagctgttcctcgagtgcctcgaaatcgccgacaagaaggaatttccagacatcaaaagcatcgtgtctgagtacataaactacctctttactgcaggggccataacgaaggaggagattatgcaggcctatgcattggagtacgccatgtactga

SEQ ID NO: 858 - DNA, 1347 bp, African swine fever virus
atgagcaatgagtcctttccggagacactggagaacctcctgtccatgctgcagactaagcagcagaatgccattcagtccgaagtgattgaatggctgcacagcttctgcgaaacgttccacctgaaaatccactgccataaacagttcattcccagtggggagaagaaacgggctaaaatccctgctcaggagactcagggcaatacccagccatctcaccatgtgtaccgcgttgtactgtccagagcccaacctgtcaaagcccaagagtcactcttgaccacaatgtgcaatggacttgtgctggatgcgaacacctggacctgtcttgctatcccacctcctgcaccctttcagcaagcaactcgccaggtgcaacacttctacaggaacaacttctacgaggtagtccccattcaagacggaacactgctgacaatctatcactgggatgaccctgagtatggtccctcctggtgtctggcctctacccatggctatgacgtgagtaattactgttggataggggataaaacctttgctgagctggtctacgagcttctgcagcaacacagcacttgcgatgttacactggaaaagaacaagaccagaggaacacgcctcttcttcgataacctcaacccagactattgctacactatcgggatcaggcaccataacttgcagcccctcatctacgatccgcagaacatttgggccattcagagcaccaatctgaaaacgctcaaaaccgtctatcccgaatactatggctacatcggcattccaggcatccagtctcaggtcccagaacttcctcagtacgacttgccctatctcatacggagctataaaaccgccatgaatcaggcgaagaatgctattaagaatgggaagaaggacaagggctactttaactacggttacttgctgatatcacgagcaccagcgataacaaagagcactagcaacgttctcctgaagagtcccctgctggtgttccttcagaagtctgtgtaccagaagaagcacaatatcagcaacagtcaacgcctggaattcatcatcctgcagaactacctgatgcagcattttcgggaccacttcatcgccctgtttccccagtacatatcctactacacgaaataccagaacatgctcaacatgatcatccactccattgccaccaaagacaaggaccatccgtttgctggagcagtggtgaagaaggtgctggaggatatcgagaatgccgagaacatcattgaccacaccacgatccagaactatgcccatcagtcaaagtatgccatgctgtatttgtctattatcagccacttctga

SEQ ID NO: 859 - DNA, 3402 bp, African swine fever virus
atggcatatcccgagctggacgctgctgacttcctccaacaattggctcggcgcaaggagttcaagtccctgatctcccctcccgtggatcagaaagaactgattcgggatctgagagcccactttgtgcagatcggaggcccaggatgtgaaaagggaggcagggccttctttccctgtgatccgtacgcctctccttttccttccatcaaagggctgcagctgcataatgcccagctcttcgtgcagaatttccagaatccaaacaccccttatagtcgcctcttgctcaattggcaaaccggcaccggcaaatccatcgccgcaattgccattgcccgacagttcatgaatcactacatgaacttcatcgagaacgcaccttggatcttcgtggtgggcttcactagagccatcatccagaccgagatgctgcgacgccccgaactcggattcgtcagttataaagaagtggctgagcttcacaggctgcttcatatcgcgaagcaatccgggtcaaccacaagtgtcgagtcacggcacctcaatggcttcgtgagcaccctgaagaggaggcttaccgaccggaatcgcggcggattctttcagttttacggctacaaggaatttgccagcaaactgttcaacattacctctaaaggcgaggaaaagaactttgatgtgttgagcctcttccaccggtctgacgaagccgaggacacgctgaacgaaaacgacatctcccagtttgtccagaaaatttccgaggccgaaaccaacggactcataagagtcaaccagaaaatcatggagcagctcagaggcggactgctcatcgctgacgagattcacaacgtgtacaatatccaggagcgcaacaactatggtatagccctgcagtacgttctggatgcattcccaccccatcaggctccaagggctgtgttcatgagtgccactccggttacaggttccgtgatggagtacgttgatctgctgaatttgcttgtgcctcggcatgaattgcccaatgggcagccactgcaacggcagcagctgtttgacagcagcggccattctgtgaagtggaagaaggacgctctcgctctcgtggaacgactgagcacgggaagagtttccttcctgctggatacgaatacaaacttttatcccgaacgcatcttcgcaggaaagatgcttagctacaaagacgagacactgccgtatctccactttattgagtgccccatgtctgagtaccagctggaaaccctgaagcagctggggcccgaccctaaaatctcttccaatgcctactcaatctatgatatggtattcccgaacccaaagtttagcaagcaaacagaaccaaaggcgtatgggctcttcaacagcactgagactccaaccgcgttgtctatggcatccacggactggctgctggaaaacggagtccagataatagagccgagtcgccgagcacccttcaacgtcagcggctcttttctgtcactgcaaccacccacccatatcagcgggcttgccttttacagtggcaagtatacccagatgatgaaggacatactgtccataattcgacaggggaggggcaagattctgatctaccacaacagggtacgcatgagtggggtgttgatactgcaggaaatccttcagagcaatgggattctgaacgaagtctcatctcccgtcgggaccactcgctgttccatttgcgctgcaattagggacgaacacacacacagcgaccaccagtttatccctgttcgcttcaccatcctgcatagcgaaatcgagcccgccgtgcgcgagcgctccctggccctgttcaatgccagcagtaaccttgaaggtcaccaactgcgcattctgatcgggtccaaggtcatcgtcgagggactgaacttccaggctgtgcgctatgagatgattatgtctctgcccttggatataccgcggctgatccaggtatttgggcgcgttgtgcggaagaacagccatatggagcttccacccagtgagcggaatgtgaccatctacctgtacgtcagcaccacacccgatggtggcccggagctggccaaatacgcccagaaattgaaggagtacatcctcatccaggagggtgacaaagcgctgagaaagcacgcaattgatggttttaccaaccagatcaagatcgacaagcctatgctcgagtctttgcccctgagtccctccattactcctgccaatgtaggggctacagtgctgaatacctttgaggcctatggctacggtgagcaggaggttaaaactatttccaacatcattatcagccttttcatggcaaggcctgtgtggacatacagcgaactctggaaggcggtgtccacacctaagcttatacagggtatcacgattgacaacaaactcttcagcgaggacaatttcgcccttgcgctgataagcctctgctatagcaagaatcaatgcaaagagttgtggatacagaacaggctgtgcactattatgcacgtgcccgccaaacccgagcacctgtacgttgctgcggtgctgaaccataagaaagagcctgtcctggacatcgagacatacatccgcgattttcagccaccagcaatgcacagcatcaggatcactaaatacttggagcatagccaaacgaaggagcccttccaggtcctctacgagaaatttcaaaaggacttccaggatgagccgatggagcaagtcctcatccattatcccgcctcattccactacacaatgctcgaggcccttatcatcgacaatctggctgggatgggagctctggtggaggtatacaagaaattcttcatcgcattttcaaagaaggatatccagcccttcccagacatctttaagatcatcagccacgtgcctggcgacgacaataccctggtgggatatgccaccgaggatagcgtgagactgatcacgtcaagagaggacaaaacgtggcacgagataccactgtacatgctcaacattaacgtgaagagaaaagagaacgacatagtcattggctacatggaatccaaggggaaagctctgaaattcaagatccggccaccgattcaggttctgaagaagaacgaaattaccgatattcggatgctcaatagaggcgcggtctgcgaaactaggggccgcgaagagcagcaaaagatcgccgatcagctgggcatctcactgaacctgaccaagatctctgccattaagctctgtctgttgatccggaacaacctgctgcagaaagaaatggaagcccgaaaccagcctaatgggatgcaggatggcattagatggttctatctctttaacgacaagatgccttccctggtgcacacttcttga

SEQ ID NO: 860 - DNA, 711 bp, African swine fever virus
atgagagggatactcatagcgatcgaaggcatcaatggcgtaggaaagtccactcaggccatgaaactgaaggagactctggaatgtatggactataacgccatttgcatccactttcccaatcctgatacaaccactggtgacctgattctccaagtcctcaataagacgattgagatgtccagcgaacagctgcacaagctgttcaccaaacatcggagtgagtttatcgccgaaatagcagtgctgttgaagctgaactacatcgtcatcgtggataggtacatttggtcaggactggtctatgcccaagctgatgggattacgatcgagacaaagaacacctttaaacccgattataccttctttctgtctagcaagaaacctttgaatgagaaaccacttacacttcagcgacttttcgaaaccaaggagaagcaggagacaatcttcacgaacttcaccattatcatggatgacgttccgaagaaccgcttttgcattattccagctactctgaacaaggagatcatccacatgatcatcctcaccaaaaccctgaaagtgttcgacaacaatagctgtctgaactacatcaagatgtacgacgacaagtatctgaatgtgcaggacttgaacctctttgacttcgattggcagaaatacatagaggacaacaatgataaggaggaatacgacttcatcgtgtga

SEQ ID NO: 861 - DNA, 924 bp, African swine fever virus
atgacaacccacatatttcatgctgatgacctccttcaggccttgcaacaggctaaggccgagaagaacttttcctccgtattcagccttgattgggacaaactgagaactgcgaagcgcaatactacggtaaagtacgtcactgtcaacgtgatcgtcaagggcaagaaggctcccctgatgttcaacttccagaatgagaagcacgttggcaccattccaccatctaccgacgaagaagtgattcgaatgaacgcagagaacccgaaattcctggtcaagaaacgggatagggacccttgtctgcagttcaacaagtacaagatcagccctccacttgaggacgatggtctgaccgttaagaagaacgaacaaggggaagagatttatcccggcgatgaggagaaaagcaaactcttccagataatcgagctgttggaggaggcgtttgaggacgccgttcagaaaggacccgaagccatgaaaaccaaacacgtgatcaaactgattcagcggaaaatctccaacagtgctgtgaagaatgcagacaagccactcccgaatcccatagccagaatccgcattaagatcaatcccgcaacatccattctgacacccatcctgctggacaagaacaaacctatcaccctgcagaatggcaaaacgtctttcgaagagctcaaggatgaagatggggtcaaagccaatcctgacaacattcacaagttgatcgaaagccactcaattcatgacggaatcatcaacgcaaggagcatctgcattagcaacatgggcatttcctttcctctgtgcctcgagatgggtgtggtgaaggtgtttgagaagaacaacgggatcgacgtgaatagtatctacggatctgacgatatctcaacactggtgaatcagatagccatcgcctga

SEQ ID NO: 862 - protein, 117 aa, African swine fever virus
MDTETSPLLSHNLSTREGIKQSTQGLLAHTIAKYPGTTAILLGILILLIIILIIVAIVYYNRTIDCKSSIPKPPPSYYVQQPEPHHHFPVFFRKRKNSTSLQSHIPSDEQLAELAHS

SEQ ID NO: 863 - DNA, 354 bp, African swine fever virus
atggacactgaaacgtctccactgctttctcataacctgtcaacccgcgagggaattaaacaaagcacccaaggccttttagcccatacaatcgccaaatatcccggaacaactgcgattctcctgggcattttgattttgctcattattattcttatcatcgttgccatcgtttactataaccggactattgactgcaagtcgagcatacctaaacctcctcctagctactatgtacaacaacctgagcctcaccaccatttcccggtattctttagaaaaaggaaaaactccacctccctgcagtcccacattccaagcgacgaacaattagctgaacttgcgcattcataa

SEQ ID NO: 864 - protein, 117 aa, African swine fever virus
MDTETSPLLSHNLSTREGIKQSTQGFLAHTIVKYPGITAIILGILILLVIILIVVAIVYYNRSVDCKSTMPKLPPPGYYVQQPEPHHHFPVFFRKRKNSTSQQHIPSDEQLAELAHS

SEQ ID NO: 865 - DNA, 354 bp, African swine fever virus
atggacactgaaacttctccactgctttctcataatctgtcaacccgcgagggaattaaacaaagcacccaaggctttttagcccatacgatcgtgaagtatcccggaataactgcgatcatcctaggcattttgattttgctggttattattcttatcgtcgttgccatcgtttactacaaccggtctgttgactgcaagtcgaccatgcctaaacttcctcctcctggctactatgtacaacaacccgagcctcaccaccatttcccagtattctttagaaaaaggaaaaactccacctcccagcagcacattccaagcgacgaacaattagctgaacttgcgcattcataa

SEQ ID NO: 866 - DNA, 1428 bp, African swine fever virus
atggatcaggaagaatcccacgttataagtatttttgaaacccttggtgcgtattttatcaacattttttataactttttatacaaaaatgcactatacaaaaaacattccattgttacggaatatcagtatcaagtaaagggctatattttaggggttaaacaaaataaaaaactttatgaaaaaatgctagatagtttttacaaatatttttgtaacattacccaaattaacagcaaaacattaaacttttcaaacttcgtaacaacgattgttgattctttcatacctaaagaatacagccaatctataagccttgaaaagaaagaatctatcttggaattgctactgtgcgactacattagcaatctgggcacctttatcacaacagaaaaaatgctgccctttattatcaaaaaccggaaagaaaactaccataaagttacgaaagaaatgcaagattatagtcttacctttctgctcaaaaaaagaatggaactatacaataaatttctgcgaaaacaggcctatgtggagccggagacagaattagaagaaacgtatgcaagacttagttcatacaatcgcagccttcttcatcaaattgaagaattaacatctgaaaacaagtcgctcttagcagatctctccacgctacgtaaaaaatatgaaaaaagacagagtgaataccggcgacttgttcaactcctttatcagcaaattcaacgctcttctacatcaaagagcagctatccactcacaaagtttattgaaacattaccctctgaacatttttctaatgaagaataccaaaaagagacaccagcggatcaaaaagaagtagtagagatggaattattgagaaaacaagaactattaacaagccaagagctaaccagcaagtcaccaaacaattatcccgtgccacattcgaggactatagtaagtaaaccattagataactatcccgtgccacggtctaggacaacaactaaaatagattttgataattctcttcaaaaccaagagcttcacactaaaaacggatttagcgagaaagatattgttgagtttggtcaggataaacctgaagaagaaaatattcttgcgattgatcaggataaacctgaggaagaaactattcttgcgattaaacaggatatatctgaagaagataatatttttgcgattgatcaggataaacctgagtttaatcaagatacacctgagtttaaagaagctgttcttgatatcaaagaaaatatccttgaagaagaaaatcaagatgagcctattgttcaaaatccattcttggaaaatttttggaaacctgagcagaagacattcaaccagtcgggcctttttgaagaatcttcaaattttagcaatgattggtccggcggagatgtaactctaaatttttcataa

SEQ ID NO: 867 - DNA, 1428 bp, African swine fever virus
atggatcaggaagaatcccacgttataagtatttttgaaacccttggtgcgtattttatcaacattttttataactttttatacaaaaatgcactatacaaaaaacattccattgttacggaatatcagtatcaagtaaagggctatattttaggggttaaacaaaataaaaaactttatgaaaaaatgctagatagtttttacaaatatttttgtaacattacccaaattaacagcaaaacattaaacttttcaaacttcataacaacgattgttgattctttcatacctaaagaatacagccaatctataagccttgaaaagaaagaatctatcttggaattgctactgtgcgactacattagcaatttgggcacctttatcacaacagaaaaaatgctgccctttattatcaaaaaccggaaagaaaactaccataaagttacgaaagaaatgcaagattatagtcttacctttctgctcaaaaaaagaatggaactatacaacaaatttttgcgaaaacaggcctatgtggagccggagacagaattagaagaaacgtatgcaagacttagttcatacaatcgcagccttcttcatcaaattgaagaattaacatctgaaaaaaagtcgctcttagcggatctctccacgctacgtaaaaaatatgaaaaaagacagagtgaataccggcgacttgttcaactcctttatcagcaaattcaacgctcttctacatcaaagagcagctatccactcacaaagtttattgaaacattaccctctgaacatttttctaatgaagaataccaaaaagagacaccggcggatcaaaaagaagtagtagagatggaattattgagaaaacaagaactattaacaagccaagagctaaccagcaagtcaccaaacaattatcccgtgccacattcgaggactatagtaagtaaaccaccagataactatcctgtgccacgatctagaacaacaactaaactagattttgataattctcttcaaaaccaagaacttcacactaaaaacggatttagcgagaaagatattgttgagtttggtcaggataaacctgaggaagaaaatattcttgcgattgatcaggataaacctgaggaagaaaatattcttgcgattaaacaggatatacctgaagaagaaaatattcttgcgattgatcaggataaacctgagtttaatcaagatacacctgagtttaaagaagctgttcttgataccaaagaaaatatccttgaagaagaaaatcaagatgagcctattgttcaaaatccattcttggaaaatttttggaaacctgagcagaagacattcaaccagtcgggcctttttgaagaatcttcaaattttagcaatgattggtccggcggagatgtaactttaaatttttcataa

SEQ ID NO: 868 - DNA, 1104 bp, African swine fever virus
gccctaacagttgaagagcttgggctcagcaaggccgcgcgatcgcaggttgacctcaaccaggcaattaacacctttatgtattactattatgtggcccagatttactccaatttaacgcataacaaacaggagtttcaatcctacgaggaaaactatgccactattctcggagatgctattgcgggacgcctcatgcagttggatacggaaaaaaatgcgcgcattaattctccggctgtagatcttgccagaggacacgtgggcccaaatcctggaggtgcccaggaagtagactggaaggcaaccgtaagcgccatcgagctggagtatgatgtaaaacgccgattctatcgagctctggaagggctagatctttatcttaaaaacattaccaaaacgtttgtaaacaacatagattctattcaaacagtccaacagatgctggatggcgtgcgcattataggacgatggttcaccgagacaacaggggacacgcttgcacaagtctttgaaagttttcccacctccacaggcaacgactccaacgtctttacggataatgctcctgcgggccactactacgaaaaagttgcggctgaaatccaacaaggccgaagcgttggtaccctccgtcccgtcagagcaagccaggctaaaaacattcgcgaccttatcgggcgctctctttctaactttcaggcgcttaaaaatatcatcaatgcctttgcccggattggggacatgcttgggggagaggagctgcggcaaatggtgcccatgtcgcccctgcaaatctataaaaccttgcttgaatatcttcaacattctgcgctttccgtgggacttaaaaatctaaatcaatcagaaattggaggacaaaggatggcgcttgcacagactgccgaggaagcggctcagcgggtctacctctctactgtgagagttaacgacgccctatcaacccgctgggaaaccgaggacgtcttcttcaccttcatgctgaaaagtatggccgccaagatttttattgtattagggatttacgacatgtttgaacggcctgagcccgtgtacaaacttatacccacgcgtatgatattg

SEQ ID NO: 869 - DNA, 1104 bp, African swine fever virus
gctctcacagttgaagagcttgggctcagcaaggccgcgcggtcgcaggttgacctcaaccaggcaattaatacttttatgtattactactatgtggcccagatttactccaatttaacgcataacaaacaggagtttcaatcctacgaggaaaactatgccactattctcggagatgctattgcgggacgcctcatgcagttggatacggaaaaaaatgcgcgcattaattctccggctgtagatcttgccagaggacacgtgggcccaaaccctggaggtgcccaggaagcagactggaaggcagctgtaagcgccatcgagctggagtacgatgtaaaacgccgcttctatcgagctctggaagggctagacctttatcttaaaaacattaccaaaacgtttgtaaacaacatagattctattcaaacagtccagcagatgttggatggcgtgcgcattataggacgatggttcaccgaggcaacaggggacacgcttgcacaagtctttgaaagttttcccacctccgcaggtaacgactccaacgtctttacggataatgctcctgcgggccactactacgaaaaagttgcggctgaaatccaacaaggccgaagcgttggtaccctccgtcccgtcagagcaagccaggctaaaaacattcgcgaccttatcgggcgttctctttccaactttcaggcgcttaaaaatatcatcaatgcttttgcccggattggagacatgcttgggggagaggagctgcggcaaatggtgcccatgtcgcccttgcagatctataaaaccttgcttgaatatattcaacattctgcgctttccgtgggacttaaaaatctaaatcaatctgaaattggagggcaaagggtagcgcttgcacgaactcccgaggaagcggctcagcgggtctacctctctactgtgagagttaacgacgccctatcaacccgctgggaaaccgaggacgtcttcttcaccttcatgctgaaaagtatggccgctaagattttcattgtattaggcatttatgatatgtttgaacggcctgagcctgtgtacaaacttatacccacacgtatgatactg

SEQ ID NO: 870 - DNA, 4746 bp, African swine fever virus
gatgagctagagcccgaggtaattcccgaggcagcagagctttacttccgccttccccgcctcgccgaattttatcaaaagttgttttcctttagagatgaaaatgtacagatctcgatgcttcctgagctggaaggaatcttctcaggacttattcgcattatctttatgcgtcctattgagcttattaacattggtgactactcagaaaccgaaattcgtcagcttatcaaagaaataaacgtcatttaccaacactttaacttagagtatggtgaacaagaagcaaccaaaaaagcgcttatccattttgtaaatgaaataaaccgcagattcggtgtcattacacgcaccgaatgggaaaaatttcaacgcattgttcaggaagcgcgaactatgaatgattttggaatgatgaatcaaaccaactactccattcttcctgatgaggatggctatacacaatcctcacaattacttccctccgataggtttattagtccttcaacccagcctacccccaagtggcgcccggcactatacaatatagactctgtggatgtccaaacaggaatgctgcagcccaactcccagtgggatttggtacaaaaatttaggaaacagcttagtgagatgtttgaagatcccagtctgcaacaagaattgggcaaaatttcctaccaagaactcattcgccaggctatcaatgaactcaaaaaggagcataccgataaaattcaaatcgtttcaaaacttattcaaggctctgagtcactggcagatacagatgttaacaaaatatttctgtttcatgaaaccgttattacaggtcttaacttattgagtgctatttacgtacttcttaataactttcgtaataacattaaaggtttagacctagatacgattcaaaaaagcattatcgaatggttacgagagacacaagctgccaacgtgaaccgcgccaatcttattgactggctcggaagaaaacacggggccatctctgagattagaaatccaggattagtcattaaagaaatcaatatgcggctttctatggtgtaccctgatcccactaccgaagcggctgcagcagcccaagaccgaaatttaaccacagaaactctttttgcttggattgtaccatatgtgggtattcctgctggtggaggagttcgtccggagcaagagttggccgcaaggtatttagtagataatcagcgaatcatgcagctcctgttgaccaatatcttcgaaatgacctccagttttaacaaaatggttcaagttcgcttccctgaaaccagcaccgctcaagtgcatttagattttacaggtcttatttccttaattgattctttgatggccgacacgaagtattttcttgatcttctacgcccgcatattgataaaaacattattcaatactatgaaaatagatctaatcctggctcattttactggttggaagaacatttaattgacaaacttattaaaccacctaccgatgccggaggaaggccgcttcctggcggtgaattgggcctggagggggttaaccaaatcattaataaaacctacaccttgcttacaaagccttataatgtactgcaacttcgaggtggggcgcaaagaagggacgcggctaatattcaaataaataacaatccccaatcctctgaacgctttgaacaatacggaagagtattcagtagactcgtattttacgatgctttggagaataactctggacttcgtgtagagcaggtggcactaggagactttagactctccaatcttattcgtaccaacaacgcccaggaggaaaatactcttagctactgggacaacatagcgctcagaacctatgccaatgtcaatgatgccgcaaacaaccttcgacgttatcgcctatacggatcagactatggtattcaaaataatcgtagtatgatgatggtgtttaaccagctcatagcttcatatattacccgattttatgatgctcccagcggaaaaatatatctaaatcttattaatgcattcgctaatgggaactttagccaagcagtgatggagatgggatatgctcaccctgacttagcacgcaataacaacgtctttggtcatagaggcgaccccacagagcagtcggtgcttcttctgtctttgggacttatacttcagcggcttattaaggataccaatcgccagggcctgagtcagcatcttatttctactttaacagaaattcccatttaccttaaagaaaattatagagccaatcttccactatttaacaaaatgtttaatattcttattagccagggagagcttctaaaacaatttatacaatacacaaatgtccaactagctcgccctaatctgacggcactcttgggagccaataatgattccgttatttattataataataacaatgttcctgcgacaggactatccgtcggtcaggcggccctgcggggaattggcggcgtatttcgtcccaatgttacgcttatgcccctaggagacgcacaaaataatacgagcgatgttgtgcgaaagcgactggtcgcagtgatcgacgggatcattagaggctctcacactctggcagattctgccatggaggtcctgcacgagcttaccgatcatcccatctatcttgaaacagaagaacacttcattcaaaactatatgtcccggtacaataaggagcctcttatgccattttcactttcgctctattatttacatgacctaagaatagaaaataatgaggtatatgatcctcttctttacccgaaccttgaaagcggctcccccgagtttaaactactatacggcacaagaaaattactgggaaatgatccggtacagctctcagatatgcccggagtacagcttatcatgaaaaactataatgaaacggtagttgctcgcgaacaaattactcccacgcgatttgaacacttttatacccacgccattcaggctctccgatttatcataaatatccgtagttttaaaacagtgatgatgtacaatgaaaatacttttggtggagttaatcttattagcgagaacagagacgataaacccattataacagcgggaatagggatgaatgcagtgtattcgcttcgtaaaacattgcaagacgtaatttccttcgtggaaagctcttaccaagaggagcaaatcaatcatattcacaaaatagtgtcgccgaaaggtcaaacacgcactcttggctctaatagagagcgcgagcgcatatttaacttgtttgatatgaatattatacctatcaatgtaaatgcgctgatgcgatctataccacttgccaatatttacaactatgactatagttttgaagaaattgcttgtcttatgtacggcatttcggctgaaaaagtacgatctctggacaccacggctcctcaaccagatgttgcagaggtattaaacattccgaatcgtccccccataaatactcgagaatttatgctaaaacttcttataaacccctatgtctcggtctctattactcaatatgggaatgagttactatccaaaggcaacgccggatacatgtcacgcatctttagaggggacaacgcgctaaatatgggccgccctaaatttctttctgaccaaattttcaataaagtgctatttggaagcctttatcctacacaatttgattatgacgaggcaggtcctagtttggccgcaggtattcaacgtggacgtgagcggtggggccatcccatgtcaatatacataaaccaggccttacatgaaattgtgcgtactatacgattggctgaaacagttcgaggtttaagaaatgttattgatagaaaccaaattataggcgagttaaatgcatttaggactcagcttgaagatacacgaagagaagtgaataatctaatacaaacacctgaaattcaaaacaatccaacccctgagatcatcgctgccattcaaaactgggtacaacaatatcgaggtcaaataaccaatttaatcgatcttataggaaatgccgggcaagccaattcgatgataaatttaatacaaaatattacgccccaaacagccggtgcacaattaaccgctttattcaacatacgtggattacctgccccgcctccccgtcaagcattacaaaatgatattgaagcaatgcaatggtttatgacaatggttataaaccatccacctgttttaatagcacccttcatgctactcgtaaataaccttaaggaatttttaaatacgctagaacgatatgtttataaaactccacgatggttgggtcccggtacagcccgaattgcacaaccgccagttggaatggcaccaggtattaatatgcgacatcatacctcatatacagaaaatagtgtgctgacctatatcacggaacaaaatcgggaagaaggaccctggtccatcgttaaacaagtgggagttggaatacaaaagcccaccttagtacaaattggaaaggatcgctttgacactcgcctcatacgcaatctaatatttattacaaatatacagcgactattacgactgcgtctaaacctagaactctcgcagttcagaaatgtgcttgtcagtcctgaccacattataaaccccagcattacagagtatgggttctccatcacaggacccagtgagaccttctcagataaacagtatgatagtgatattcggatttta

SEQ ID NO: 871 - DNA, 4743 bp, African swine fever virus
gatgagctagaacctgaggtaattcccgaggcagcggaactttacttccgccttcctcgcctcgccgagttttatcaaaaactgttttccttcagagatgaaaatgtacagatctcgatgcttcctgagctggaaggaatattctcaggacttattcgcattatctttatgcgtcctattgagcttattaacattggtgactactcagaaaccgaaattcgtcagcttatcaaagaaataaacgtcatttaccaacactttaacttagagtatggtgaacaagaagcaaccaaaaaagcgcttatccattttgtaaatgaaataaaccgcaggttcggcgttatcacacgcactgaatgggaaaaatttcaacgcattgttcaggaagcgcgaactatgaatgacttcggaatgatgaatcaaaccaactactccattcttcctgatgaggacggctatacacaatcctcgcaattacttccctccgataggtttattagtccttcaacccaacctacccccaagtggcgcccggcactatacaatatagactctgtggatgtccaaacaggaatgctgcagcccaactcccagtgggacttggtacaaaaatttaggaaacagcttagtgagatgtttgaagatcccagcctacaacaagaattgggcaaagtttcctaccaggaactcattcgccaggctatcaatgaactcaaaaaggagcataccgacaaaattcaaattgtttcaaaacttattcaaggctctgagtcactggcagatacagatgttaacaaaatatttctgtttcatgaaaccgttattacaggtcttaacttattaagtgctatttacgtacttcttaataactttcgtaataacattaaaggtttagacctagatacgattcaaaaaagcatcattgaatggttacgagaaacgcaagccgctaacgtgaaccgagccaatcttattgactggctcggaagaaaacacggggccatctctgagattagaaatccaggattggttgttaaggaaaatgatgtgcggctttctagggtgtatcctgatccaactaccaatgcgactgcaccccaagaccaaaatttagtcacagagactctttttgcctggattgtaccatatgtgggtattcctgctggtggaggagttcgtgcggagcaagaattagccgcaagatatttggtagacaatcagcgaatcatgcagctcctgttgaccaatatcttcgaaatgacctctagttttaacaaaatggttcaagttcgctttcccgaaactagcaccgctcaagtgcacttagattttacgggtcttatttccttaattgattctttgatggccgacactaagtattttcttaatcttctacgcccacatattgataaaaacattattcaatactacgaaaatagatccaatcctggctcattttactggctggaagaacatttgattgacaagcttattaaaccacccaccgatgccgggggaaggccgcttcctggcggtgaattaggcctggagggagttaaccaaatcattaataaaacctacatcttgcttacaaaaccctataatgtactgcaacttcgaggtggggtacaaagaagagatgcagctaatattcaaataaataacaatccccaaccctctgagcgctttgaacaatatggaagagtatttagtagactcgtattttacgatgctttggagaataactctggactccgtgtagagcaagtggtactaggagactttagactctccaatcttattcgtaccaacaatgcccaggaggaaaatactcttagctactgggacaatatggcgcccagaacctatgccaacgtcaatgatgccgcaaacaaccttcgacgttatcgcctatatggatcagactatggtattcaaaataatcgtagtatgatgatggtgtttaaccagcttgtagcctcgtacattgcccggttttatgacgctcccagcggaaaaatatatcttaatcttatcaatgcattcgccaacgggaactttagccaagcggtgatggagctggggtacactcatcccgacctagcacgtgataacatcgcctttggccataggggcgaccccacagagcagtcggtgctccttttgtccttgggtctcatgcttcagcggcttattaaggatactaaccgccaaggcctgagtcaacatcttatttccacgttaacagaaattcctatctatcttaaagaaaattatagagccaatcttccactatttaacaaaatgtttaatattcttattagtcagggggagcttttaaaacaattcatacaatacacaaatgtccaactggctcgtcctaatctgatggggctcttgggggccaataatgattccgttatttactataataataatattaatgttcctatgacaggactatccgtcggtcaggcggccctgcggggaattggcggcgtatttcgtcccaatgttacgcttatgcccctaggagacgcacaaaataatacgagcgatgttgtgcgaaagcgattggtcgcagtgatcgacgggatcattagaggctcccacactctggcagactctgccatggaagtcctacatgaacttaccgaccatcccatctatcttgaaacagaagaacacttcattcaaaactatatgtcccggtacaataaggagcctcttatgccattttcactttcgctctattatttgcgtgacctaagaatagagaataatgaggtatatgatcctcttctttacccaaaccttgaaagcggctcccccgagtttaaactactatacggcacaagaaaattactgggaaatgatccggtacagctctcagatatgcccggagtacagcttatcatgaaaaattataatgaaacagtggttgctcacgaacaaattactcccacgcgattcgaacacttttatacccatgctattcaggctcttcgatttatcgtaaatatccgtagttttaaaacagtgatgatgtacaatgaaaatacttttggtggagttaatcttattagcgagaacagagacgataaacctattataacagcgggaatagggatgaatgcagtgtattcgcttcgtaaaacattgcaagacgtgatttccttcgtggaaagctcttaccaagaggagcaaatcaatcatattcacaaaatagtatcgccgaaaggccaaacacgcactcttggctctaatagagagcgcgagcgcatatttaacttgtttgatatgaatattatacctatcaatgtaaatgcgctgatgcgatctataccacttgcgaatatttacaactatgactatagttttgaagaaattgcttgtcttatgtacggcatttcggccgaaaaggtacgatcgctaaacaccgcggctcctcagccagatattgcagaggtattaaacattccgaatcgtccccccatgaacactcgagaatttatgctaaaacttcttataaacccctatgtttcagtctctatcacccaatatggaaacgaattgatgagcaagggcagtgctggatatatgtcacgcatttttagaggagataatgcgctgaacatgggccgtcctaagtttctttccgaccaaatttttaataaagtgttatttggaagtctgtaccccacacagtttgactatgatgaagcaggcccgggtttggccgcaggtattcaacgtggacgtgaacaatgggggcaacccttatcagaatacatcaatcaggctttacatgaacttgtccgtaccataagaatacctcagaaacttcgagttctaagaaatattattgttaaaaaccaacttatagcggatttaactacaattagagagcagcttgtaagtatgcgaagagaagttgaaaacatgatacaaactcctgaaattcaaaacaatccaacccctgaggtcattgcagccgctcaaaactggacacagcaataccgagctcgggtagataccttaattaattttataggaaatattgggcaacccaattcaatgttagacttaatacaaactattacgcccgtaacagtgcgagcacaattaggcgtcatttttaatagacatggaatccctgttccacatccccgtcagatactacaaactgatgatgaagcgactcaatggtttatgaccaatattttaaacatacctgccattataatgacaccctttacggacctcgcaaatgatcttagaacatttttagaaactttggaacgatatgtttttaatgttccaagatggttgggtcctagcacaggacgagttgcacgagcacccgttcgtatggcacctagagatatgcgacatcccatttcatatacggaaaatagtgtgctcacctatatcacggaacaaaatcgggaagaaggaccctggtccatcgttaaacaagtgggagttggaatacaaaagcccaccttagtacaaatcggaaaggatcgctttgacactcgcctcatacgcaatctaatatttattacaaatatacagcgactattacgactgcgtctaaacctagaactctcgcagttcagaaatgtgctcgtcagtcctgaccacattataaaccccagcattacagagtacgggttctccatcacaggacccagtgagaccttctcagataaacagtatgatagcgatattcgaatttta

SEQ ID NO: 872 - DNA, 3750 bp, African swine fever virus
atggaggaagtaattacgatcgcgcaaatagtccaccgtggcacagatatcttatcgctcaataatgaggaaatcgaggcactagtggatgaaatctactctacccttaaagggtctaatgatataaaaaacatacgtttaatagactttcttttcactctaaaagattttgtgaaccatgttcgcgccgagcagtcaaagctgcccgatctatccatgcccatagaggcctacatacgtcaactgctggtagaccccgatgtggtccccatcgtgagtgaaaaaaaaaaggaattacgtgttcgccctagcacacgcaaagaaatttttttaattaatgggacgcacctggccgttcccgcagaagcccccattgaaatctatggacttaagttgcggctaaaaactttttccccgcagtgttttatgcgtatggctgagataggctccttctcgcctgaaaccttgggctacgtcgcctcaggagccaatttgaccaattttattcgagtatttatgaaatgcgtggatcaagaaacctggaaaaaaaacggagaaggggttgtcgtaaccaccaaggaaaacatcatccagtttacgcaccagtatatcgaactttataagtttttgcggagcggcgggcatagctggctcattaatcggctagcagaggagatggtacaccgaaagctagaccgtgaggatcagggcagtcatatatctaatatcgttgaaaccgaggagattgaaccggaggagaacattaagcgcgtgatattttttttaaaagagttgtctacgatgtactcggtgtccccggtttttacatcgggatacatgcccttgctttatgacctatatagagcaggctatttggaggtgctttggaaccctgtagaacaaaagtttttacaacatgctgaacagcgtgaaaaggagcaaatgattctgcagcaggtggacatgaagctcacagaggtcattacccaggcgagacagtattttaaaattatggaagaaaaaataggtagggtgcagtcggatgctatacgtgaaattcttacaatggagggtaaagtggatgaccctaacagcatccttcaagaagtcattaaagcctgtgggaaacaggaggcagaacttattacaacagaatacctaaacattaaaaaacagtgggaactccaagaaaaaaatgcatgtgctcatctcaagctggtaaaacagttgcgttcgggtcttcaatacgcggagttattaaaagtattagaaagtattcgtgtactctacaaggaaaaaaacaataccaccaattggaatctatgcaaagcctgcgggtttaagctgctttgtccccatgtggacatgcttatacagcttcaagcggcagaagcgtcctacgacaccatgcgaaccaagctaatgaaattttcaggaataaacaaggagaaagaaaacaaccaggggcttatttactcctacttttgcaaaatttgtggcgaagagctggcccattttattcaagaggatcgtacggcagatgtgggcatcatcggcgatcttaatagtaagctccgtgtttttatttggcaggaaaccatgaaggcctgcacgtttatccactttggaaagcttgtagacgtgaaacagtttgccaatatagccgtaaatgtctgcctgccgctcgtgtatagcatcgaaaatattaaaaaggaagaggattacgatcctttaacgcagctgtatgctgtgatctacatctatgcctatattttgaatctcatttatagctcgcaaaaaaataaagaatttcttacgattaccattcatggaatgaaggcggatagctctttgaatgcatacgtgacctttcttttggagaaaatgatgcagcaatatagcggtataataaatcagctatctgagattacggatcagtggattgctaataattttcgggaggctttcaaaaaaattatccaccaaaatgggctacaagggcttagcgtgcaggacgacaccaaggtacttttgacagagattctgctggaccccatgtatgattatgctgccacagtggcccgtattgacggcagcatccctatgcacaaaccacggactcccaaggaggctgaatatgagtttaaaaccgtgataggacgtaccccggccgagctattatcgcaaaaagaattttatgataaaatttatacctctaaatatcggcctgattttacgcagttgacgcgtctgaatgacatctattttcaagaagaaagcctgcgggtgtggtggggaggacgggatgaggaaaaaacctcaactctcatttaccttagagcctatgaattatttcttaagtatttacaaaatgcacctaattttaactccgaacttgcagaattcaaaacgtacgaaaatgcttatggcgagcaaaaggccctgcttgctcagcaaggattttataacatatttgatcctaacacaggaagagccgaccaacggactcggctgtttgagtataaaaggcttcccatttcaaccctatacgatgaaagggggcttcctcataagtggaccatttacgtttacaaggccgtagacagttcgcagaaacccgccgagattgaagtaacacgcaaagacgtcataaaaaaaattgacaaccattatgcacttgccgatctacgctgttctgtatgccacgtgctacaacatgaggtggggcaattaaacataaaaaaggtccaaacagccctaaaggcgagcttagaatttaacaccttttatgccttctacgagtcacgctgccccaagggaggattacacgacttccaggataaaaaatgtgtcaagtgcggactttttacctatattatatacgatcatctttctcaacccgaattagttcatgactattataataattataaagaccagtacgataaggaaaagatgtcgatccgttctattcaaataaagaaagatatgaccacgccctccaccgaaacacaacccaagcctccacaggagccatggactttcgattacggaaaaataatcaagacggccaagattttggatatcagtcctgctgtgatagaggccataggggccatggaggggcgctcctacgcagacatcagggaaggccagggtgccccgccaccacctacctcaatggatgatccaaggctcatggcggtcgactctgccgtacgtattttcttatataattataactgtttgcggcacgttagtacatttaacaagcctcctatacatgttgaaaggcttgtaaagcacctgtcgtacgaggaaaaggaggatttggaaaaggtgctgcctaacgttgtgaatgaatatcacactacatttaaacacctacgggtaacagatcctgccagcgccttgctttactctatagaatttttatgtataagtttcttaacgctgtatgaaattaaagagccctcctgggttgtgaatattgtgagagagtttgcgctgacagaactcaacactattattcaaagcgaaaagctgttaagtaagcccggtgcatttaactttatgatttttggagaggactttgtgtgctctggggaagatagctccatggacgacatctcggcctacagttctcccggactttttggggaagacattattgaccggctcgatgacccttttagcatcgaggatgttgacatttctttagatgtgttggacaacttagcgccccagtag

SEQ ID NO: 873 - DNA, 3750 bp, African swine fever virus
atggaggaagtaattacgatcgcgcaaatagtccaccgtggcacagatatcttatcgctcaataatgaggaaatcgaggcactagtggatgaaatctactctacccttaaagggtctaatgatataaaaaacatacgtttaatagactttcttttcactctaaaagattttgtgaaccatgttcgcgccgagcagtcaaagctgcccgatctatccatgcccatggaggcctacatacgtcaactgctagtagaccccgatgtggtccccatcgtgagcgaaaaaaaaaaggaattacgtgttcgccctagcacacgcaaagaaatttttttaattaatgggacgcacctggccgttcccgcagaagcccccattgaaatctatggacttaagttgcggctaaaaagtttttccccgcagtgctttatgcgtatggctgagataggctccttctcgcctgaaaccttgggctacgtcgcctcaggagccaatttgaccaattttattcgagtatttatgaaatgcgtggaccaagaaacctggaaaaaaaacggggaaggggttgtcgtaaccaccaaggaaaacatcatccagtttacgcaccagtatatcgaactttataagtttttgcggagcggcgggcatagctggctcattaatcggctagcagaggagatggtacaccgaaagctagaccgtgaggatcagggcagtcatatatctaatatcgttgaaaccgaggagattgaaccggaggagaacattaagcgcgtgatattttttttaaaagagttgtctacgatgtactcggtgtccccggtttttacatcgggatacatgcccttgctttatgacctatatagagcaggctatttggaggtgctttggaaccctgtagaacaaaagtttttacaacatgctgaacagcgtgaaaaggagcaaatgattctgcagcaggtggacatgaagctcacggaggtcattacccaggcgagacagtattttaaaattatggaagaaaaaataggtagggtgcagtcggatgctatacgtgaaattcttacaatggagggtaaagtggatgaccctaacagcatccttcaagaagtcattaaagcctgtgggaaacaggaggcagaacttattacaacagaatacctaaacattaaaaaacagtgggaactccaagaaaaaaacgcatgtgctcatctcaagctggtaaaacagttgcgttcgggtcttcaatacgcggagttattaaaagtattagaaagtattcgtgtactctacaaggaaaaaaacaataccaccaattggaatctatgcaaagcctgcgggtttaagctgctttgcccccatgtggacatgcttatacagcttcaagcggcagaagcgtcctacgacaccatgcgaaccaagctaatgaaattttcaggaataaacaaggagaaagaaaacaaccaggggcttatttactcctacttttgcaaaatttgtggcgaagagctggcccattttattcaagaggatcgtacggcagatgtgggcgtcatcggcgatcttaatagtaagctccgtatttttatttggcaggaaaccatgaaggcctgcacgtttatccactttggaaagcttgtggacgtgaaacagtttgccaatatagccgtaaatgtctgcctgccgctcgtgtatagcatcgaaaatattaaaaaggaggaggattacgatcctttaacgcagctgtatgctgtgatctacatctatgcctatattttgaatctcatttatagctcgcaaaaaaataaagaatttcttacgattaccattcatggaatgaaggcggatagctcgttgaatgcatacgtgacctttcttttggaaaaaatgatgcagcaatatagcggtataataaatcagctatctgagattacggatcagtggattgctaataattttcgggaggctttcaaaaaaattatccaccaaaatgggctacaagggcttagcgtgcaggacgacaccaaggtacttttgacagagattctgctggaccccatgtatgattatgctgccactgtggcccgtattgacggcagcatccctatgcataagccacggactcccaaggaggctgaatatgagtttaaaaccgtgataggacgtaccccggccgagctattatcgcaaaaagaattttatgataaaatttatacctctaaatatcggcctgattttacgcagttggcgcgtctgaatgacatctattttcaagaagaaagcctgcgggtgtggtggggaggacgggatgaggaaaaaacctcaactctcatttaccttagagcctatgaattatttcttaagtatttacaaaatgcacctaattttaactccgaacttgcagaattcaaaacgtacgaaaatgcttatggcgagcaaaaggccctgcttgctcagcaaggattttataacatatttgatcctaacacaggaagagccgaccaacggactcggctgtttgagtataaaaggcttcccatttcaaccctatatgatgaaagggggcttcctcataagtggaccatttacgtttacaaggccgtcgacagttcgcagaaacccgccgagattgaagtaacacgcaaagacgtcataaaaaaaattgacaaccattatgcgcttgccgatctacgctgttctgtatgccacgtgctacaacatgaggtggggcaattaaacataaaaaaggtccaaacagccctaaaggcgagcttagaatttaacaccttttatgccttctacgagtcacgctgccccaaggggggattacacgacttccaggataaaaaatgtgtcaagtgcggactttttacctatattatatacgatcatctttctcaacccgaattagttcatgactattataataattataaagatcagtacgataaggaaaagatgtcgatccgttctattcaaataaagaaagatatgaccacgccctccagcgaaacacaacccaagcctccacaggagccatggaccttcgattacggaaaaataatcaagacggccaagattttggatatcagtcctgctgtgatagaggccataggagccatggaggggcgctcctacgcagacatcagggaaggccagggtgccccgccaccacctacctcaatggatgatccaaggctcatggcggtcgactctgccgtacgtattttcttatataattataactgtttgcggcatgttagtacatttaacaagcctcctatgcatgttgaaaggcttgtaaagcatctgtcgtatgaggaaaaggaggatttggaaaaagtgctgcctaacgtcgtgaatgaatatcacactacatttaaacacctacgggtaacagatcctgccagcgccttgctttactctatagaatttttatgtgtaagtttcttaacgctgtatgaaattaaagagccttcctgggttgtgaatattgtgagagaatttgcgctgacagagctcaacactattattcaaagcgaaaagctgttaagtaagcccggtgcatttaactttatgatttttggggaggactttgtgtgctctggggaagatagctccatggattacatctcggcctacagttctcccggactttttggcgaagacattattgaccggctcgatgacccttttagcatcgaggatgttgacatttctttagatgtgttggataacttagcgccccagtag

SEQ ID NO: 874 - DNA, 1521 bp, African swine fever virus
atgttctccctacaggatctctgtcggaagaacctttttcttccacttgagcccttaggcaagcatgtggttcaacggctgggattatactgggaaggccatggttcagttaaacgagtgggtgattgctttatatgtgtagaccagatttggatgctatcaatccataaggctatacaaattgcagcctcggaaggaaatgagaacattgtcaagcttttcttactatggaaggggagtctacaatatgccatcataggagccttagagggcaggcaatatgatctgattcaaaaatattacaaccaaattggggactgccatcagattctaccactgattcaagatccagaaatttacgaaagatgtcatgaattaaatgttacatgtacctttcaatgcttatttcaacatgctataagagataacatgctgcccattttccaaaaatatggagaagatctgaatggaaacaggagaatggttcaacttctgtatgagatggcatgccgattacaaaattatgatatcatcaaatggataggatctaacctgcatgtttataacttggaagccatttttagcattgcttttgttagaaaggatttaactttgtattctttaggctacatgcttcttctgggtagaatgagtactgaagatagaaactttatctcaatcataacacgccatcttgaatacgcatcaaaaaagggactttttgactttgtactagaatctttgaaatatggaggtcaagtggatacagtgttgtttcaggctgtaaaatacaaccataggaaaattttggcccattttattcatgaaattccccgtgaaacggttgaaaagctgatactccatgctgtggagtcacgggcctccagaaaaacattcaacctgcttttatcttccataaactactgtgtgaacccttttgtcaaaaaactactgcacgctgtggtgaaacacaagtacatgcttatcataaagcttttgctcgagcggcccaaaaagaagataaacctggtagatgctgctctattcaaacttgtaaaatactctacttatacagaaatagtaaaatacatgggtgagttttctgtggacccaaaaagggtggtcaaaatggcagcacgactcatgagagtggacctgattaaaaagatttctaatgatgcatgggaagataaactagagagaatcaagcaccttaaacagatggtaaataccatgaaccacagaaatggaaaaaatctattgatgtacaatattcacaatattactggatatacctatctgaacaccaaagaagcatttaacttaacaagattttatgctgtccacaatgcaacatgtttgtttaaagaaatgtgtaaaagctgttttgtacatgataaaatacagctcagagaattgcttgaagattgtttacatattgctaataggcatgattatatccagattgcagaaaccgcagatgaatgtatcaaatatatagatcttattacatttaagtaa

SEQ ID NO: 875 - DNA, 1521 bp, African swine fever virus
atgttctccctacaggatctctgtcggaagaacctttttcttccacttgagcccttaggcaagcatgtggttcaacggctgggattatactgggaaggccatggttcacttaaacgagtgggtgattgctttatatgtgtagacaagatttggatcctatccatccataaggctatacaaattgcagcctcggaaggaaatgagaacattgtcaagcttttcttactgtggaaggggagtctacaatatgccatcataggagccttagagggcaggcaatatgatctgattcaaaaatattacaaccaaattggggactgccatgagattttaccactgattcaagatccagaaatttacgaaagatgccatgaattaaatgttacatgtacctttcaatgcttatttcaacatgctataagagataacatgctgcccattttccaaaaatatggagaagatctgaatggaaacagaagaatggttcaacttctatatgaaatggcatgccgattacaaaattatgatatcatcaaatggataggatttaacctgcatgtttataacttggaagccatttttagcattgcttttgttagaaaggatttaactttgtattctttaggctacatgcttcttctgggtagaatgagtactgaagatagaaactttatttcaatcataacacgccatcttgaatacgcatcaaaaaagggactttttgactttgtactagaatctttgaaatacggaggtcaagtggatacagtgttgtttcaggctgtaaaatacaaccatagaaaaattttggcccattttattcatgaaattccgcgtgaaacagttgaaaagctgatactccatgctgtagaatcgcgggcctccaggaaaacattcaacctgcttttatcttccataaactactgtgtaaacccttttgtcaaaaaactactgcacaccgtggtgaaacacaagtacatgcttatcataaagcttttgctcgagcggcccaaaaagaagataaacctggtagatgctgctctattcaaacttgtaaaatactctacttatgcagaaatagtaaaattcatgaaagagttttctgtggacccagaaagggtggtcaaaatggcagcacgactcatgagagtggacctgattaaaaagatttctaacgatgcatgggaaaataaactagagagaatcaagcaccttaaacagatggtaaataccatgaaccacagaaatggaaaaaatctattgatgtacaatattcacaatattactggatatacctgcttgaacaccaaagaagcatttaacttaacaagattttatgctgtccacaatgcaacatgtttgtttaaagaaatgtgtaaaagctgttttgtacatgataaaatacagttcagagaattgcttgaagattgtttacatattgctaataggcatgattatatccagattgcagaaaccgcagatgaatgtatcaaatatatagatcttattacacctaagtaa

SEQ ID NO: 876 - DNA, 3579 bp, African swine fever virus
atggaagcgtttgaaatcagcgatttcaaagagcatgcgaagaaaaaaagcatgtgggctggcgccctcaacaaagtcactatttcgggtcttatgggggtctttaccgaagatgaggaccttatggcgttacccattcacagagaccactgccccgctttgttaaaaatttttgacgagatcatcgtaaatgccacggatcatgaaagagcttgccataacaaaacaaaaaaggtaacttacattaaaatttcgtttgataaaggtgtgttttcttgcgaaaacgatggcccgggaatccccattgcaaagcatgagcaagccagtcttatcgccaagcgcgatgtgtatgttcccgaggtggcttcatgtcactttttagccggaacgaacatcaataaggccaaggactgtatcaaggggggaaccaacggcgtcgggctgaagctcgccatggtgcattcgcagtgggccattcttaccaccgccgacggcgcgcaaaagtatgttcaacatatcaaccaacgcctagatatcattgagcctcctaccattacaccctccagggaaatgtttacacgtatcgagctcatgcccgtataccaggaactagggtacgcggagcctctgtctgaaacagagcaggcggatctttccgcctggatttaccttcgcgcctgccaatgcgcggcctacgtgggaaaaggcaccaccatttattacaatgataagccttgccgcacgggctctgtgatggcgctagccaaaatgtacaccctgttgagcgcgcctaatagcacgatacatacggcgaccattaaggccgacgcaaagccctatagcctgcaccccctgcaggttgcggcggtcgtgtcccccaagtttaaaaaatttgaacacgtgtccgttatcaacggggtaaattgcgtaaaaggagaacatgtcacctttttgaaaaagactattaatgaaatggtcgttaaaaaatttcaacaaacgattaaagataaaaaccgcaaaacaacattacgagacagctgttcaaacatctttatcgttatagtgggttccattccaggaatagaatggaccggccagcggaaggatgaacttagcatcgcggaaaatgtttttaaaacgcattactccattccttctagttttttaacaagtatgacaaagtctatcgtggatattcttctgcaatccatttctaaaaaagataaccataaacaggtcgacgtagacaaatatacgcgtgcccgcaatgcgggaggaaaaagggcgcaggactgcatgctactcgcggcggaaggggatagcgcactttccctgctgcgcacgggactaaccctgggaaagtccaacccaagcgggccctcctttgacttctgcggcatgatctccctgggaggagtcatcatgaatgcctgcaaaaaggtgacaaacattacaacggactctggagaaaccattatggtgcgcaacgaacagcttaccaataataaagtgttgcagggaatcgtgcaggtattgggtctagacttcaactgccattacaaaacacaggaagagcgagcaaagctgagatacggctgcattgttgcgtgcgttgatcaagatctggatgggtgtggaaaaatccttggactgctgctggcctactttcacctgttttggcctcagcttattatccatggtttcgtaaaacgactgcttaccccgctgatacgtgtgtatgaaaagggtaagaccatgcccgtggaattttactatgaacaagagtttgatgcctgggcaaaaaagcagaccagcttagccaaccataccgtaaaatattacaagggattggcggcgcatgacacccatgaagtaaaaagcatgttcaaacattttgacaacatggtgtacacgtttaccctggatgactcagcaaaggagttgtttcatatttattttggcggggagtcggagttgcgaaaaagagagctttgcaccggcgtggtgccgctcaccgaaacccagacgcagtccattcatagtgtccgacgaattccttgcagcctgcatctgcaagtagataccaaggcttacaagctggatgccatcgagcggcagattcccaacttcttagacgggatgacgcgggcgcggcgcaaaattttagccgggggggtgaaatgcttcgcctccaacaaccgtgaacgaaaggtttttcagttcgggggctacgttgcagatcacatgttttatcaccatggcgacatgtcgttaaacacaagtattataaaagccgcccagtattacccaggctcctcccacctctatccggtattcataggcataggaagttttggctccaggcacctgggaggaaaggatgcaggatccccaagatacatcagtgtgcagcttgcgtctgaatttattaaaacaatgttccccgcggaggactcatggcttctcccctacgtctttgaggacggccagcgggcggaaccagagtactacgtgcctgtgttgccgcttgctattatggagtacggcgccaacccatcggagggctggaagtacaccacttgggcccggcaactggaagacattttggccttggtgagggcctacgtcgacaaagacaacccaaaacacgagctactgcactatgcaataaaacataagattactatactcccgctgcggccctccaattacaatttcaagggccatttgaagcggtttggccaatactactacagctacggcacgtacgtcatctcagagcagcgaaatataattactattacggagcttcctctgcgtgttcctacggttgcatacatcgaaagtataaaaaaatcgagtaaccgcatgacatttattgaagaaatcatcgactacagtagttcagaaactattgaaattctggtgaaattaaagccaaatagtcttaaccgtatcgtggaagaatttaaggagactgaagagcaagattccatagaaaattttctgcgcctgcgcaattgtttacattcacatctaaactttgtaaaacctaaaggtggcattatcgagtttaacacgtattatgaaattttgtatgcgtggctaccttacaggcgtgagctttaccaaaagcgtcttatgcgtgagcacgcggtgcttaagctgcgcattatcatggaaactgctattgtacgctacatcaatgagtctgcagagctaaatctttcccattatgaggatgaaaaggaggcaagccgcattctaagcgagcatggatttcccccgctgaaccacacgctgatcatttcccctgagtttgcctctatagaggaactcaatcaaaaagcactgcagggctgttatacctatatactatctttgcaggctcgagaattgcttatcgcagccaaaactcgtcgggtggaaaaaataaaaaaaatgcaagctcgtcttgataaggttgagcagcttttgcaagagtctccctttcccggcgccagcgtatggctggaggaaattgatgcggtggaaaaggctattataaaaggaagaaatactcagtggaaatttcattaa

SEQ ID NO: 877 - DNA, 3579 bp, African swine fever virus
atggaagcgtttgaaatcagcgatttcaaagagcatgcgaagaaaaaaagcatgtgggctggcgccctcaacaaagtcactatttcgggtcttatgggggtctttaccgaagatgaggaccttatggcgttacccattcacagagaccactgtcccgctttgttaaaaatttttgacgagctcatcgtaaatgccacggatcatgaaagagcttgccatagcaaaacaaaaaaggtaacctacatcaaaatttcgtttgataaaggcgtgttttcttgcgaaaacgatggcccgggaatccccattgcaaagcatgagcaggccagtcttatcgccaagcgcgatgtgtatgttcccgaggtggcttcatgcttctttctagccggaacgaacatcaataaggccaaggactgtatcaaggggggaaccaacggcgtcgggctgaagctcgccatggtgcattcgcagtgggccattcttaccaccgccgacggcgcgcaaaagtatgttcaacaaatcaaccagcgcctagatatcattgagcctcctaccattacaccctccagggaaatgtttacacgtatcgagctcatgcccgtataccaggaactagggtacgcggagcctctgtctgaaacggagcaagcagatctttccgcctggatttatcttcgcgcctgccaatgcgcggcctacgtgggaaaaggcaccaccatttattacaatgataagccttgccgcacgggctctgtgatggcgctggccaaaatgtacaccctgttgagcgcgcctaatagcacgatacatacggcgaccattaaggccgacgcaaaaccctatagcctgcaccctctgcaggttgcggcggtcgtgtcccccaagtttaaaaaatttgaacacgtgtccattatcaacggggtaaattgtgtaaaaggagaacatgttacctttttgaaaaagaccattaatgaaatggtcattaaaaaatttcaacagacgattaaagataaaaaccgcaaaacaacattacgtgacagctgttcaaacatctttgtcgttatagtgggttccattccaggcatagaatggaccggccagcggaaggatgaacttagcatcgcagaaaatgtttttaaaacgcattactccatcccttctagttttttaacaagcatgacaaggtctatcgtggatattcttctgcaatccatttctaaaaaagataaccataaacaggtcgacgtagacaaatatacgcgtgcccgcaatgcgggagggaaaagggcgcaggactgcatgctactcgcggcggaaggggatagcgcactttccctgttgcgcacgggactgaccctgggaaagtccaacccaagcgggccctcctttgacttctgcggcatgatctccctgggaggggtcatcatgaatgcctgcaaaaaggtgacaaacattacaacggactctggagaaaccatcatggtgcgcaacgaacagcttaccaataataaagtgttgcagggaattgtgcaggtattgggtctagacttcaactgccattacaaaacgcaggaagagcgagcaaagctgagatacggctgcattgttgcgtgcgttgatcaagatctggatgggtgtggaaaaatccttggactgctgctggcctactttcacctgttttggcctcagcttattatccatggtttcgtaaaacgactgcttaccccgctgatacgtgtgtacgaaaagggcaagactatgcccgtagaattttactatgaacaggagtttgatgcctgggcaaaaaagcagaccagcttagtcaatcatactgtaaaatattacaagggattggcggcgcatgacacccatgaagtaaaaagcatgttcaaacattttgacaacatggtgtacacgtttaccctggatgactcggcaaaggagttgtttcatatttattttggcggggagtcggagttgcgaaaaagagagctttgcaccggcgtggtgccgctcactgaaacccagacgcagtccattcatagtgtccgacgaattccttgcagcctgcatctgcaggtagataccaaggcttacaagctggatgccatcgagcggcagattcccaacttcttagacggaatgacgcgggcgcggcgcaaaattttagccgggggggtgaaatgcttcgcttccaacaaccgtgaacgaaaggtttttcagttcgggggctacgttgcggatcacatgttttatcaccatggcgacatgtcgttaaacacaagtattataaaagccgcccagtattacccgggctcctcccacctctatccagtattcataggcataggaagcttcggctccaggcacctgggaggaaaggatgcaggatccccaagatacatcagtgtgcagcttgcgtctgaatttattaaaacaatgttccccgcggaggactcatggcttctcccctacgtctttgaggacggccagcgggcggaaccagagtactacgtgcctgtattgccgcttgctattatggagtacggcgccaacccatcggagggctggaagtacaccacttgggcccggcaactggaagacattttggccttggtgagggcctacgtcgacaaagacaacccaaaacacgagctactgcactatgcaataaaacataagattactatactcccgctgcggccctccaattacaatttcaagggccatttgaagcggtttggccaatactactacagctacggcacgtacgacatctcagagcagcgaaatataattactattacggagcttcctctgcgtgttcctacggttgcatatatcgaaagtataaaaaaatcgagtaaccgcatgacatttattgaagaaatcatcgactacagtagttcagaaaccattgaaattctggtgaaactaaagccaaatagtctcaaccgtatcgtggaagaatttaaggagactgaagagcaagattccatagaaaattttctgcgcctgcgcaattgtttacattcgcatctaaactttgtaaaacctaaaggtggtattatcgagtttaactcatattatgaaattttatatgcgtggctaccttacaggcgtgagctttaccaaaagcgtcttatgcgtgagcacgcggtgcttaagctgcgcattatcatggaaactgctattgtacgctacatcaatgagtctgcagagctaaatctttcccattatgaggatgaaaaggaggcaagccgcattctaagcgagcatggatttcccccgctgaaccacacgctgatcatttcccctgagtttgcctctatagaggaactcaatcaaaaagcgctgcagggctgttatacctatatactatctttgcaggctcgagaattgcttatcgcagccaaaactcgtcgggtggaaaaaataaaaaaaatgcaagctcgtcttgataaggttgagcagcttttgcaggagtctccctttcccggcgccagcgtatggctggaggaaattgatgcggtggaaaaggctattataaaaggaagaaatactcagtggaaatttcattaa

SEQ ID NO: 878 - DNA, 1596 bp, African swine fever virus
atgttctctctccagaacttatgtcgaaaaacattacctaaccgtaaacttcctgaattttttgacgaatatatattacaactgctgggattatactgggaaaaccatggaactattcaacgagcaggaaacaactgtgtgcttatacagcaacataccctcattcccgtaaatgaagccctgagaacagcagcatctgaagaaaattatgagatcgtgagccttttattagcgtgggaggggaacctttactatgctattataggggctctagagggcaaccgccacgacttaattcgtaaatatgatgaccaaatcaaggaccatcatgaaattctgccattcattgacgatccagtcatatttcacaaatgccatatcatgcggcaatgcttttttgattgtattttatatcaagctgtaaaatatagtaagtttcgcgttcttctttactttaaacatagattagaggatgatttgcccttcactcatttacttattgaaaaggcatgtaaagatcataattatgaagttattaaatggatatatgaaaacctacatatctacaatatgatagatacctttgaatgtgctattgcccataaggatctacatctatattgtttggggtatagatttatatataacagaatcgtacccgataagtatcatcatttagatattcgcatgctttcaagcctacaactcctacataaggtggcagccaaaggatacttagattttatcctagaaaccttaaagtatgatcataataaagataatataaatattattctaacacaagctgcaacctataaccatagaaaaattttaatctatttcattcctcaatcaacccacgcacagatagaacaatgtttactagtggcgataaaagcaaaatcttccaggaaaaccttgaacttactactgtctcacctaaacctttccatcaacctcatcaaaaaaataagccattatgttgccacttacaattcaacaaatataataggcattctgagtatgcggcggaaaaagaagatatatttagatatcatattgacaaaatttgtaaaaaaagctatttttaataagtttgtcgttcgatgtatggatacattttctataaacccggaaagaatccttaaaatagccgcgcgaataaataggatgatgttagtgaaaaaaatatctgaacatgtttggaaaaatcatgcggttagacttaaataccttaaacatgcggtacacacgatgaagcataaagatgggaaaaatagactcatgaactttatctatgatcgctgttattaccatatgcaaggggaagaaatctttagcctcgcaagattttatgcaatccatcatgcaccaaagttgtttgacgttttttatgattgttgtatcctagatacgatacgattcaaaagccttcttttagattgttcacatatcataggtaaaaacgctcatgatgctaccaatatcaacatcgtgaacaagtatatcggcaacctgtttgttatgggagttcttagcaaaaaagaaatcttacaggactatccatccatttattctaaacaatacatgccttag

SEQ ID NO: 879 - DNA, 1596 bp, African swine fever virus
atgttctctctccagaacttatgtcgaaaaacattacctgactgtaaacttcctgaattttttgacgattatatattacaactgctgggattatactgggaaaaccatggaactattcaacgggcaggaaacaactgtgtgcttatacaacaacataccctcattcccgtaaatgaagccctaagaatagcagcatctgaagaaaattatgagatcgtgggccttttattagcgtgggaggggaacctttactatgctattataggggctctagagggtaaccgctacaacttaattcgtaaatatgatgatcaaatcaaggaccatcatgacattctgccattcattgatgatccaatcatatttcacaaatgccatatcatgcggcgatgcttttttgattgtattttatatcaagctgtaaaatatagtaagtttcgtgttcttctttattttaaatatacattagaggatgatttgcccctcgttcatttacttattgaaaaggcatgtgaagatcataattatgaagttattaaatggatatatgaaaacctacatgtctgccatataatagatacctttgactgtgctattgcccataaagatctacgtttatattgtttggggtatacatttatatacaacaggattgtaccctataagtatcatcatttagatattctcatactttcaagcctacaactcctacataaggtggcggccaaaggatacttagattttatcctagaaaccttaaagtatgatcataatatagataatttagatgttattctaacacaagctgcaacatataaccatagaaaaattttaacctattttattcctcaatcaacctacgcacaaatagaacaatgtttgttcgtggcgataaaaacaaaatcttccaagaaaaccttgaacttactactgtctcacctaaacctttccatcaaactcatccaaaaaatcagccaatatgttgccactttcaattcaacaaatataataggcattctgagtatgaagcggaaaaagaagatatatttggatatcatattgacaaaatttgtaaaaaatgctatttttaataaatttgtcgttcgatgtatggagagattttctataaacccggaaagaatcgtcaaaatggctgcgcgtataaataagatgatgttagtgaaaaaaatatctgaacatgtttggaaaaatcatgcggctagacttaaacaccttaaacatgcggtacacacgatgaagcataaagatgggaaaaatagactcatgaactttatctatgaacactgctattaccatatgcaaggggaagaaatttttagcctcgcaagattttatgcaatccatcatgcaccaaagttgttcgacgttttttataattgttgtatcctagatacgatacgattcaaaagccttcttttagattgttcacatatcataggtaaaaacgctcatgatgctactaatatcaacatcgtgaacaagtatattggcaacctgtttgctatgggagttcttagcaaaaaagaaatcttacaggactatccatccatctattctaaacattatatgccttag

SEQ ID NO: 880 - DNA, 843 bp, African swine fever virus
atgtcctcttctcttcaggaactttgtcgaaaaaagctgcctgactgcatacttccagagttttttgacgactatgtattgcaactgttaggactgcactggcaagatcatggttcccttcagcgtatcgagaagaaccagatacttgttcaacaggaacccatccatatcaatgaagcactcaaagtagcagcatcggaagggaactatgaaatcgtagagctgttgttgtcatgggaggcagatccccgctacgccgtcgtaggagccctagaaagcaaatactatgacctggtttacaaatactatgaccaagttaaagactgccatgatatcttgccgctgattcaaaatccggaaacattcgaaagatgtcatgagttaaacagcacctgttcactgaaatgcttattcaagcatgctgtgataaatgacatgctgccgattcttcaaaaatatacagactatctggataggtgggagtattgcagccagatgctgttcgaactggcatgtagtaaaaaaaaatatgagatggttgtgtggatagagggagttctaggcgtcggcaaagttacatctcttttcaccattgcgattagcaacagagacctacagctgtattctctgggctactcaattatccttgagaatttgtactcctgtggacaggaccccaagtttttactaaatcatttcctgcgagacgtttcaataaaagggcttctaccctttgtaatcaaaaccatagaatatggtggaagcaaggagatagccataactctggctaaaaaatatcagcataaacatattttgaaatacttcgaaacctgggaaagctag

SEQ ID NO: 881 - DNA, 843 bp, African swine fever virus
atgtcctcttcccttcaggaactttgtcgaaaaaagctgcctgactgcatacttccagagttttttgacgactatgtattgcaactgttaggactgcactggcaagatcatggttcccttcagcgtatcgagaagaaccagatacttgttcaacaggaacccatccatatcaatgaagcactcaaagtagcagcatcggaagggaactatgaaatcgtagagctgttgttgtcatgggaggcagatccccgctacgccgtcgtaggagctctagaaagcaaatactatgacctggtttacaaatactatgacctggttaaagactgccatgatatcttgccgctgattcaaaatccggaaacatttgaaaaatgtcatgagttaaacaacccctgttctcttaaatgcttattcaagcatgctgtgatacatgacatgctgccgattcttcaaaaatatacatactttctggatgggtgggagtattgcaaccagatgctgttcgaactggcatgtagtaaaaaaaaatatgagatggttgtgtggatagagggagttctaggcatcggcaaagttacatctcttttcactattgcgattagcaacagagacctgcacctgtattccctgggccacttaatcattcttgagagaatgcagtcctgtggacaagaccccacgtttttactaaatcatttcctgcgagacgtttcaataaaagggcttctcccttttgtactgaaaaccatagaatatggtggaagcaaggagatagccataactctggctaaaaaatatcagcataaacatattttgaaatacttcgaaaccgggaaatgctaa

SEQ ID NO: 882 - DNA, 1257 bp, African swine fever virus
atgtccaattactattattactatggcggggggagatatgattggttaaaaacagtagaacccactaattttttaaaaatcgggttgccttaccaggcacacccattacatcttcaacatcaggcaactactcccccatctatcttagaaaaatttaaacgagcagacattcttcttaatgaggtgaaggccgaaatggacccactcatgttacaaccagaaaccgaaaaaaaactattccagatattgagtagtattgatatgttcaaaggtctgcgaaaaaaagtagaattcacgtacaatgctcaaattgttacgaatgcttggcttaaaatgtatgagctgctaaataccatgaattttaataatacatctcaggcattttgcaattgtgagcttccaggagggtttataagtgcaattaaccattttaattatacaatgatgcattaccctacttttaactgggtagcttcctccctttaccccagttcggaaacagatgccctggaagatcactatggtctttatcagtgcaatccggataactggttgatgcaatctcctttactgaaaaaaaatatagattataataacggggacgtaaccatcgctagcaatgtaaaaaacctagcgcttagagccacacaaaggctgacgcccatccatctatatacggctgatgggggtattaatgtaggacatgactacaataaacaggaagaattaaatcttaagcttcactttggtcaagcccttacgggtttgttgagtcttagcaaaggcggaaacatgatactcaaacactataccttaaatcatgcatttactctttctttaatatgtgtattttctcacttttttgaggaactatacattaccaaacctacctcctctcggcccacaaactctgaaacctatattgtgggtaaaaacagattacgcttatttacccccaaggaagaacaagtccttctaaaacggctagaattttttaatgatacgcccctcgtagacctaagtctttaccaaaatttacttgaaagcgtttactttgccgtagaaacaatacatctaaaacaacaaatagaatttctaaacttcggaatgaaatgttatcgacatttttataacaagattaaactacttaacgattatttagctccgaaaaaaaagatttttcaggataggtggcgtgtgcttaataagctttatgttcttgaaaaaaagcataaacttaagctttgtgcctcctag

SEQ ID NO: 883 - DNA, 1275 bp, African swine fever virus
atgtccaattactattattactatggcggggggagatatgattggttaaaaacagtagaacccactaattttttaaaaatcgggttgccttaccaggcacacccattacacctccaacatcaggcaactactactcccccatctatcctagaaaaatttaaacgagcagatattcttcttaatgaggtgaaggccgaaatggacccactcatgttacaaccagaaaccgaaaaaaaattataccagatattaggtagtattgatatgttcaaaggtctgcgaaaaaaagtagaatttacgtacaatgctcaaattgttacgaatgcttggcttaaaatgtatgagctgctaaataccatgaattttaataatacatctcaggcattttgcaattgtgagcttccaggagggtttataagtgcaattaatcattttaattatacaatgatgcattaccctacttttaactgggtagcctcctccctttaccccagttcggaaacagatgccctggaagaccactatggtctttatcagtgcaatccggataactggctgatgcaatctcctttactaaaaaaaaatgtggattataatgacggggacgtaaccattgctagcaatgtaaaaaatctagcgcttagagccacacagaggctgacgcccatccatctatataccgctgacggaggtattaatgtagggcatgactacaataaacaggaagaattaaatcttaagcttcactttggtcaagctcttacaggtttgttgagccttagcaaaggcggaaacatgatactcaaacactataccttaaatcatgcatttactctttctttaatatgcgtattttctcacttttttgaggaactatacattaccaaacctacctcctctcggcccacgaactctgaaacctatattgtgggtaaaaacaggctacgcctatttactcccaaggaagaacaaatacttttgaaacgactagaattttttaatgatacgcccctcgtagacctaagtctttaccaaaatttacttgaaagcatttactttgccgtagaaacaatacatctaaaacagcaaatagagtttctaaacttcggaatgaaatgttaccgacatttttataacaagattaaactacttaacgaatatttagctccgaaaaaaaagatttttcaggataggtggcgtgtgcttaataagctttatgttcttgaaaaaaagcataaacttaagctttgtgcccctcagggatctgttgcctaa

SEQ ID NO: 884 - DNA, 1428 bp, African swine fever virus
atgacgtctttactaaagactgattttaatgtttctaagtaccggctcattgctcaaaaacgtgaggcaaatgccgtggagattgaggcggctttggaggtggtccgcgaatttatcataaagaaaaagcttattttgtacggggggattgccattgattatgccctgcatcttaaaggcagctcaatttatcccgagggagaaagacccgactttgatatgttttcccccaaccacgttgaggacgcctacgaacttgctgacattttgtatgaaaagggcttcaagcaggtgggcacggtgcgcgccatccatgtgcagaccatgcgggtgcgcacggactttgtgtgggttgctgatctttcatatatgccccccaatatctttaacaccatacccacattaacgtataaaaaccttaaaatcattcaccccgattaccagcgggccgggctacacctagcattttgctttccttttgataacccaccaagggaagatgtttttagcaggtttaaaaaggatttgcagcggtataacctcatagaaaaatattaccccattcccgttgttcctgtgaagtcgacatacgaaagtaaaacgttttcaattccctttaaacaagtggccatacacggctttgcggcatacgccctcctgtaccagactctaaatgagctgagaattacctgcaaagtcccggagtggaaaacagaatttccacaaccatcttactcctaccataagaatgataaaaacataacacttaccgtggatatgcccaaagcctatcccgcgctggtgttagcgacgtacaacccggaagaagtcataaaagaaatgggccttcacctgactgagatatgtgagccctacatggactatagtccccctatattcaagacgaacgacatacatttttttagcactatgtttaaagagctagcgatatctatcattcaagataaccttattgtggtgtctccccagtacttactgctttattttctatacggcgcttttgcaacgcctgccgataagtcgctatttttattttactacaatgcgacgctttggattctcgaaaaggcagactccctgctaaacatcatacaaaaacaaacaagtccggaagagtttacgaggtttgctaataccagtccatttgtattaacaacgcgcgtactaagttgttcacaggaacgttgcacctttagcccggcatatagaatctccctggccaacgacgtacaacagtcgcagttacccctcccaaaaacccattttttaagcaattctctcccagatgtttcaacactcccttataattattatccgggcaagggaaaagataggcccacaaatttcagctatgaaaaaaatttattgtttaacataggaggaaaatgtactccgtctgcgatgtag

SEQ ID NO: 885 - DNA, 1428 bp, African swine fever virus
atgtcgtctttactaaagactgattttaatgtttctaagtatcggctcattgctcaaaagcgtgaggcaaatgccgtggagattgaggcggctttggaggtggtccgcgaatttatcataaagaaaaagcttattttgtacggggggattgccattgattatgccctgcatcttaaaggcagctcgatttatcccgagggagaaagacccgactttgatatgttttcccccaaccacgttgaggatgcctacgaacttgctgacattttgtatgaaaagggcttcaagcaggtgggcacggtgcgcgccatccatgtgcagaccatgcgggtgcgcacggactttgtgtgggttgctgacctttcatatatgccccccaatatctttaacaccatacccacattaacgtataaaaaccttaaaatcattcaccccgattaccagcgggccgggctacacctagcattttgctttccttttgataacccaccaagggaagatgtttttagcaggtttaaaaaggatttgcagcggtataacctcatagaaaaatattaccccattcccgttgttcctgtgaagtcgatatacgaaagtaaaacgttttcaattccctttaaacaagtggccatacacggctttgcggcatacgccctcctgtaccagactttaaatgaactgagaattacctgcaaggtcccggagtggaaaacagaatttccacaaccatcttactcctaccataagaatgataaaaacataacacttaccgtggatatgcccaaagcctatcccgcgctggtgttagcgacgtacaacccggaagaagtcataaaagaaatgggccttcacctgactgagatatgtgagccctacatggactatagtccccctatattcaagacgaacgacatacatttttttagcaccatgtttaaagagctagcgatatctatcattcaggataaccttattgtggtgtctccccagtacttactgctttattttctatacggcgcttttgcaacgcctgccgataagtcgctatttttattttactacaatgcgacgctttggattctcgaaaaggcagactccctgctaaacatcatacaaaaacaaacaagtccggaagagtttacgaggtttgctaataccagtccatttgtattaacaacgcgcgtactaagttgttcacaggaacgttgcacctttagcccggcatatagaatctccctggctaacgacgtacaacagtcgcagttacccctcccaaaaacccattttttaagcaattctctcccagacgtttcaacactcccttataattattatccgggcaagggaaaagataggcccacaaatttcagctatgaaaaaaatttattgtttaacataggaggaaaatgtactccgtctgcgatgtag

SEQ ID NO: 886 - DNA, 1593 bp, African swine fever virus
atggcagaatttaatattgatgagcttctcaaaaacgtattggaggatccctctactgaaatatccgaagaaacgcttaaacagctttaccaaaggacgaacccttacaaacagttcaaaaatgatagcagggtggccttttgctcttttacaaatttgcgggagcagtatattcgacgtcttataatgactagctttattggatatgtcttcaaagctctgcaggaatggatgccttcctattcaaaacctacccacacgaccaaaactcttctcagtgagctaataacgttagttgatactttgaaacaggaaactaatgatgttccctctgaatcggtagtaaatacaattttatctatagcagatagctgcaaaacccagacgcagaaaagcaaggaagctaaaacaacgatcgatagctttttacgagaacattttgtgtttgatcctaatcttcatgctcaaagtgcgtatacttgtgcagataccaatgtagacacttgtgcaagcatgtgtgcagataccaatgtagacacctgtgcaagcatgtgtgcagataccaatgtagatacctgtgcaagcacttgtacaagcacagaatacaccgatttagcagatcctgagcgcatccctttacacatcatgcaaaaaacattaaatgtgcctaatgagcttcaggccgatattgatgcaatcacccaaaccccacagggctatagggcagcagcccacatattacaaaatatagaacttcaccaaagcattaaacatatgcttgaaaatccgagggcgtttaaacccattctctttaacacaaaaattactagatatctttcgcagcatattccacctcaggatactttttataagtggaattattacattgaggataattacgaagagttgcgggccgctacggaaagcatctacccagaaaaacccgacctagagtttgccttcattatttatgatgtggtggatagcagcaaccaacaaaaggttgatgaattttattataaatataaagaccagattttctcagaggtttcatccattcaattaggcaactggacactcctgggaagctttaaggccaacagagagcgctacaattattttaatcaaaataatgaaataataaaacggattttggaccgtcatgaggaagacctaaagataggaaaagagattttacgaaatactatttaccacaaaaaagcaaaaaatatacaagaaactggcccggatgctccggggctctccatctataattcaacctttcacacggatagcgggattaagggactgctttcctttaaggagctaaaaaacctagaaaaagcatctggaaatatcaaaaaagctcgagagtatgattttatagacgactgcgaagaaaaaattaagcaactgcttagtaaagaaaatttaacccccgatgaagaaagcgagctgataaaaacaaaaaaacagttagataatgcgcttgaaatgctcaatgtgcctgatgatacgatacgggtagatatgtgggtcaacaataataataaactcgaaaaagaaattttatatacaaaagcagaattgtaa

SEQ ID NO: 887 - DNA, 1809 bp, African swine fever virus
atggcagaatttaatattgatgagcttctcaaaaacgtattggaggatccctctactgaaatatccgaagaaacgcttaaacagctttatcaaaggacgaacccttacaaacagttcaaaaatgatagcagggtggccttttgctcttttacaaatttgcgggagcagtatattcgacgtcttataatgactagctttattggatatgtcttcaaagctctgcaggaatggatgccttcctattcaaaacctacccacacgaccaaaactcttctcagtgagctaataacgttagttgatactttgaaacaggaaactaatgatgttccctctgaatcggtagtaaatacaattttatctatagcggatagctgcaaaacccagacgcagaaaagcaaggaagctaaaacaacgatcgatagctttttacgagaacattttgtgtttgatcctaatcttcatgctcaaagtgcgtatacttgtgcaagcacttgtgcagataccaatgtagacacctgtgcaagcacttgtgcaagcacttgtgcaagcacttgtgcaagcacaggtgcaagcacttgtgcagataccaatgtagacacctgtgcaagcacttgtgcagataccaatgtagacacctgtgcaagcacttgtgcagataccaatgtagacacctgtgcaagcacttgtgcagataccaatgtagacacctgtgcaagcacttgtgcagataccaatgtaaacacttgtgcaagcatgtgtgcagataccaatgtagacacctgtgcaagcacctgtgcaaacacctgtgcaagcacagaatacaccgatttagcagatcctgagcgcatccctttacacatcatgcaaaaaacattaaatgtgcctaatgagcttcaggccgatattgatgcaattacccaaaccccacagggctatagggcagcagcccacatattacaaaatatagaacttcatcaaagcattaaacatatgcttgaaaatccgagggcgtttaaacccattctctttaacacaaaaattactagatatctttcgcagcatattccacctcaggatactttttataagtggaattattacattgaggataattacgaagagttgcgggccgctacggaaagcatctacccagaaaagcccgacctagagtttgccttcattatttatgatgtggtggatagcagcaaccaacaaaaggttgatgaattttattataaatataaagaccagattttctcagaggtttcatccattcaattaggcaactggacactcctgggaagctttaaggccaacagagagcgctacaattattttaatcaaaataatgaaataataaaacggattttggaccgtcatgaggaagacctaaagataggaaaagagattctacgaaataccatttaccacaaaaaagcaaaaaatatacaagaaaccggcccggatgctccggggctctccatctataattcaacctttcacacggatagcgggattaagggactgctttcctttaaggagctaaaaaacctagaaaaagcatctggaaatatcaaaaaagctcgagagtatgattttatagacgactgcgaagaaaaaattaagcaactgcttagtaaagaaaatttaacccccgatgaagaaagcgagctgataaaaacaaaaaaacagttaaataatgcgcttgaaatgctcaatgtgcctgatgatacgatacgggtagatatgtgggtcaacaataataataaactcgaaaaagaaattttatatacaaaagcagaattgtaa

SEQ ID NO: 888 - DNA, 1593 bp, African swine fever virus
atgccctctaatatgaaacagttttgcaagatttctgtatggctacagcagcacgatccagatttattagaaattatcaacaacttatgtatgcttggcaatttatccgcggcaaagtacaaacacggagttaccttcatttaccccaaacaggcaaagatccgcgatgaaataaaaaaacatgcctactccaatgacccttcacaagccataaagaccttagaatcactcatccttccattttacattcccactccagcggagttcaccggggaaatcggctcctacaccggagtgaaattagaggttgaaaaaacggaggcgaataaagttattttaaaaaatggagaagcggtcctagtaccggcggccgattttaagccctttcctgatcgccgactagcggtctggatcatggagtcaggctctatgcccctggagggtcccccctataagcggaaaaaggagggtggggggaatgacccgccggttcctaagcatatctcgccgtatactccgcgcacgcgtattgccattgaggtggaaaaggcctttgatgactgtatgcgtcaaaactggtgtagtgtcaataatccctatcttgccaagtcggtctccttgctgtctttcttgtcgctcaaccatcccaccgagtttattaaggtactgccgcttatagactttgaccccttggtgaccttttatctacttcttgagccctataaaacgcatggggatgactttttaattccggaaaccattttattcggccctaccggatggaatggtacagatctgtatcaaagtgccatgctggagtttaaaaagttttttacccagattactcgccaaacctttatggacatagccgattcggctactaaggaggtagatgttcccatatgttactcggatcccgaaaccgtacattcctatgccaatcacgtgcgtactgaaattttgcatcacaatgccgtcaataaggttacaacacctaacctcgtcgtgcaggcctataatgagctcgagcaaaccaataccatacgacattacggccctattttcccggaaagtaccatcaacgcactgcgtttttggaaaaagctgtggcaggatgaacagcgatttgttatccacggcctgcaccgcacgttgatggatcaacccacctatgaaacctctgagtttgcagagatcgttagaaatttacggttttcgcgtcccggcaataactatataaacgagcttaatattacaagtcccgctatgtacggcgacaagcataccaccggagatattgcgcccaatgatagatttgccatgttggtggcctttatcaacagtactgactttttatacaccgcgattcccgaggaaaaggtaggggggaatgaaacccaaaccagtagccttacagacctagttccaacacggctacactcttttttaaatcataatctaagcaaacttaaaatcttaaaccgcgcgcagcaaacggttagaaatattctttcaaatgattgtcttaatcaactgaaacattatgttaaacacacgggaaaaaatgaaatactaaagttacttcaagaataa

SEQ ID NO: 889 - DNA, 1593 bp, African swine fever virus
atgccctctaatatgaaacagttttgcaagatttctgtatggctgcagcagcacgatccagatttattagaaattatcaacaacttatgtatgcttggcaatttatccgcggcaaagtacaaacacggagttaccttcatttatcccaaacaggcaaagatccgcgatgaaataaaaaaacatgcctactccaatgacccctcacaggccataaagaccttagaatcactcatccttccattttacattcccactccagcggagttcaccggggaaatcggctcctacaccggagtgaaattagaggtcgaaaaaacggaggcgaataaagttattttgaaaaatggagaagcagtcctggttccggcggccgattttaagccctttcctgatcgccgactagcggtctggatcatggagtcaggctctatgcccctggagggtcccccctataagcggaaaaaggagggtggggggaatgacccgccggttcctaagcatatctcgccgtatactccgcgcacgcgtattgccattgaggtggaaaaggcctttgatgactgtatgcgtcaaaactggtgtagtgtcaataatccctatcttgccaaatcagtttccttgctgtctttcttgtcgctcaaccatcccaccgagtttattaaggtactgccgcttatagactttgaccccttggtgaccttttatctacttcttgagccctataaaacgcatggggatgactttttaattccggaaaccattttattcggtcctaccggatggaatggtacagatctgtatcaaagtgctatgctggaatttaaaaagttttttacccagattactcgccaaacctttatggacatagccgattcggctactaaggaggtggatgttcctatatgttattcggatcccgaaaccgtacattcctataccaatcacgtgcgtactgaaattttgcatcacaatgccgtcaataaggttacaacacctaacctagtcgtgcaggcctataatgagctcgagcaaaccaataccatacgacattacggccctattttcccggaaagtaccatcaacgcactgcgtttctggaaaaagctgtggcaggatgaacagcgatttgttattcacggcctgcaccgcacgttgatggatcaacccacctatgaaacctctgagtttgcagagatcgttagaaatttacggttttcgcgtcccggcaataactatataaacgagcttaatattacaagtcctgctatgtacggcgataagcataccaccggagatattgcgcccaatgatagatttgccatgttggtggcctttatcaacagtactgactttttatacaccgccattcccgaagaaaaggtaggggggaatgaaacccaaaccagtagccttacagacctagttccaacacggctacactcttttttaaatcataatctaagcaaacttaaaatcttaaaccgcgcgcagcaaacggttagaaacattctttcaaatgattgtcttaatcaactgaaacattatgttaaacacacgggaaaaaatgaaatactaaagttacttcaagaataa

SEQ ID NO: 890 - DNA, 1020 bp, African swine fever virus
atgatcgaccaaaaaatttttgagacaacgttgaatattgatgatcctaccaatttttgtacaaatgtggaggctcatcttttgaaggagcttgaaaacatttatgtgggtaagtgtttcaaaaacagttttattcttaatattactggcgttatacaacgctccccttgttttattatgcgtacgaataatagcggaagaggatatatgcatgtaagattttctgctgttgtttcttacttaaatgcctttgatttaatagcggccgttaaaattattaaaaatgacagtaatattattctcggcgaaagcctattgactgaacccgtaactattgtcataccctcgtccgaatcgcaaaataatgttgcagaagtggggcaaattgtgccggtacagcttgctaacagcagcgtgtactatatacctggcagacaacaggccagtgccacggggagtattttcattcctaagcacactttttcagtctatcacgtgcaagaggagcttacacaggaacaggccttaaacctaacaaaacttgttaacattatagaaatgcttcttgaaagtcgttctaaaaaagacttcaagcagatatgcttttttgaaaaactttactatacctactctataagctcggatgagatcttagatctaaaaatatggaaagggcccaaggggaaggagatgtcgcggcttaagccttgcaatgtgctttcatttctttatgacgccctaaaaaacaagaacagcagcctagggttttgggcaagacccccaaatctccttaagtcctcgccattggcgtatcaacaagatcaaaattcttttaacgccactgaattacctattatatgttctgctgaagtaatgtttgttactctcttgaaagaaataataaactatctgcaatttataaatgatctttgtgatacgttcaataatgaacaattaataaaacgccatgaaaatatttggatgcttattgagcaaagaaaaataggacatgatttttaa

SEQ ID NO: 891 - DNA, 1020 bp, African swine fever virus
atgatcgaccaaaaaatttttgagacaacgttgaatattgatgatcctaccaatttttgtacaaatgtggaggctcatcttttgaaggagcttgaaaacatttatgtgggtaagtgtttcaaaaacagttttattcttaatattactggcgttatacaacgctccccttgttttattatgcgtacgaataatagcggaagaggatatatgcatgtaagattttctgctgttgtttcttacttaaatgcctttgatttaatagcggccgttaaaattattaaaaatgacagtaatattattctcggcgaaagcctattgactgaacccgtaactattgtcataccctcgtccgaatcgcaaaataatgttgcagaagtagggcaaattgtgccggtacagcttgctaacagcagcgtgtactatatacctggcagacaacaggccagtgccacggggagtattttcattcctaagcacactttttcagtctatcacgtgcaagaggagcttacacaggaacaggccttaaacctaacaaaacttgttaacattatagaaatgcttcttgaaagtcgttctaaaaaagacttcaagcagatatgcttttttgaaaaactttactatacctactctataagctcggatgagatcttagatctaaaaatatggaaagggcccaaggggaaggagatgtcgcggcttaagccttgcaatgtgctttcatttctttatgacgccctaaaaaacaagagcagcagcctagggttttgggcaagacccccgaatctccttaagtcctcgccattggcgtatcaacaagatcaaaattcttttaacgccactgaattacctattatatgttctgctgaagtaatgtttgttactctcttgaaagaaataataaactatctgcaatttatgaatgatctttgtgatacgttcaataatgaacaattaataaaacgccatgaaaatatttggatgcttattgagcaaagaaaaataggacatgatttttaa

SEQ ID NO: 892 - DNA, 732 bp, African swine fever virus
atgaaaatgcatatagcccgcgattctatcgtatttttgctaaataagtatttgcaaaatactatccttacaaataagattgaacaagaatgttttttacaggctgacacgcctaaaaaatatttacaatatattaaaccatttttaataaattgtatgactaagaatattaccaccgatctagttatgaaagattccaaaagactagaaccctatattattttggaaatgcgtgatatcatccaaatgatgttttttagaacgcttcaaaaacatatgttttttaaggaacatactgatttatgcaccgaatacgcgcaaaaaatcgaggcctcgtgttatcattatacgtaccagcaacaagaaaaaacctttttagaagaatattcaacccgttgtgggacgatcaatcatattattaactgcgaaaaaaaaagtcaccaacaacaggataacgatgcccttaataagctaatttctggcgagctaaaaccggaggcaattggtagcatgacgttcgccgagctttgcccctctgccgccttaaaggagaagacagaaattactctacgttcgcagcaaaaggtcgccgaaaagacgtcacaactttataagtgtcccaactgcaagcagcgtatgtgtacctacagagaagtacaaacacgcgccctcgatgagccatccacgatattttgtacctgtaaaaaatgcgggcatgagtttattggctaa

SEQ ID NO: 893 - DNA, 732 bp, African swine fever virus
atgaaaatgcatatagcccgcgattctatcgtatttttgctaaataagcatttgcaaaatactatccttacaaataagattgaacaagaatgttttttacaggctgacacgcctaaaaaatatttacaatatattaagccatttttaataaattgtatgactaagaatattaccaccgatctagttatgaaagattccaaaagattagaaccctatattattttagaaatgcgtgatatcatccaaatgatgttttttagaacgcttcaaaaacatatgttttttaaggaacatactgatttatgcaccgaatacgcgcaaaaaatcgaggcctcgtgttatcattatacgtaccagcagcaagaaaaaacctttttagaagaatattcaacccgttgtgggacgatcaatcatattattaattgcgaaaaaaaaagtcaccagcagcaggataacgatgcccttaataagctaatttctggcgagctaaaaccggaggcaattggtagcatgacgttcgccgagctttgtccctctgccgccttaaaggagaagacagaaattactctacgttcgcagcaaaaagtcgccgaaaagacgtcacaactttataagtgtcccaactgcaagcagcgtatgtgcacctacagagaagtacaaacacgcgccctcgatgagccttccacgatattttgtacctgtaaaaaatgcgggcatgagtttattggctaa

SEQ ID NO: 894 - DNA, 219 bp, African swine fever virus
atggagactcagaagttgatttccatggttaaggaagccttagaaaaatatcaataccctcttactgctaaaaatattaaagtagtgatacaaaaagagcacaatgtcgtcttacctacaggatctataaatagcatactgtacagtaactcagaactttttgagaagattgataagacaaataccatttatcccccgctttggatacggaaaaactaa

SEQ ID NO: 895 - DNA, 222 bp, African swine fever virus
atggagactcagaagttgatttccatggttaaggaagccttggaaaaatatcaataccctcttactgctaaaaatattaaagtagtgatacaaaaagagtacaatgttgtcttacctacaggttctataaatagcatactgtacagtaactcagaactttttgaaaagattgataagacaaatactatttatcccccgctttggatacggaaaactaactaa

SEQ ID NO: 896 - DNA, 717 bp, African swine fever virus
atggctcgtggtcaaaatattcgtaagaggacgttctccgatatggacactccttcagataaaaatataggaatccatactaattctttacctaagaataacttgtatagaagaatattatttaaaggtaaaatatctaactatagtatatccaaggacagcttggctaaagatcattcatctaatcatagtatctcgaaaaacggtttaattggaaaaaagcgtccagctccccttgatatatcgtttcagaatatgaattcctctatttcatctagtacccaaaaaaagacaagaattttagacgaagaaatcaaagatcaaagtttatcaaatgaaaatgatagagattctcctgttattgtggatataaccttaaaaccatcttacatgtcaaaaacatcacggattacggaaattatacataagatgaaggaacttaacatgaaccgtattgaggacggttcatctttcaacaaaaaaagaagtgagcatgatgataaaaatattctcctacacactatggaaatggaggaggaggattgcgagatagaagaggatattgctatagatagtccatatttaaatacttctctttctgaggatgacaccgattctattgtaggaacagattattctgaggaagaaaaagaaactatctctgaaacggaatcttcatccgacgatgagtcctattcactttatgatagtttctaa

SEQ ID NO: 897 - DNA, 717 bp, African swine fever virus
atggctcgtggtcaaaatattcgtaagaggacgttctccgatatggacactccttcagataaaaatataggaatccatactaattctttacctaagaataacttgtatagaagaatattatttaaaggtaaaatatctaactatagtatatccaaggacagcttggctaaagatcattcatctaaacatagtatctcgaaaaacggtttaattggaaaaaagcgtccagctccccttgatatatcgtttcagagtatgaattcctcgatttcatctagtacccaaaaaaagacaagaattttagacgaagaaatcaaagatcaaagtttatcaaatgaaaatgatacagattctcctgttattgtggatataaccttaaaaccatcttacatgtcaaaaacatcacggattacggaaattattcataagatgaaggaacttaacatgaaccgcattgaggacggttcatctttcaacaaaaaaagaagtgaacatgatgataaaaatattctcctacacactatggaaatggaggaggaggattgcgagatagaagaggatattgctatagatagtccatatttaaatacttctctttctgaggatgacaccgattctattgtaggaacagattattctgagaaagaaaaagaaactatctctgaaacggaatcttcatccgacgatgagtcctattcactttatgatagtttctaa

SEQ ID NO: 898 - DNA, 291 bp, African swine fever virus
atgggaactttttcagtaactgcctctgcaaaaagtgacgatgctgtttgtaagtatttagaagaaccaatagatgaaaattacagaaacatattaagaaatgagcatgttaaaaaaaatttaaatgaggctctgaatcgacatattactacctataatccagtagttgattggtgtaataactattcaacattttcatctcaggatttcgatgaatataaaatttatatacatagcgatcttatggatggacgacctcgtccaaaaaaaacatggtgtgtcatcatgtaa

SEQ ID NO: 899 - DNA, 297 bp, African swine fever virus
atggaaaccttttcagtaactgcctctgcgaaaagtgacgatgctgtttgtaagtatctagaagaaccaatagatgaaaataaaaattctagaaacatattaagaaatgaacatggtaaaaaaaaattaaatgaggctctgaatcgacatataattgcttataatccagtagttgattggtgtaataactattcaacatattcatctcagtatttcgatgaatataaaatttatatacatagcgatcttatggatggacgacctcgtccaaaaaaaacatggtgtgtcatcatgtaa

SEQ ID NO: 900 - DNA, 45 bp, African swine fever virus
tcatttccgctttgcttggaaatgggagttgtaaaagtttttgaa

SEQ ID NO: 901 - DNA, 45 bp, African swine fever virus
aaaaataatgggattgatgtgaactccatttatggctcagacgat

The invention claimed is:

1. An immunogenic composition comprising
   (a) an African swine fever virus (ASFV) polypeptide MGF100-1L, wherein the MGF100-1L polypeptide is selected from amino acid sequences which are at least 95% identical to an amino acid sequence selected from the group of: (SEQ ID NOS: 572, 570);
   or
   (b) a heterologous viral or bacterial vector comprising African swine fever virus oligonucleotides encoding African swine fever virus polypeptide MGF100-1L, wherein the MGF100-1L polypeptide is selected from amino acid sequences which are at least 95% identical to an amino acid sequence selected from the group consisting of: (SEQ ID NOS: 572, 570); and
   (c) one or more pharmaceutical- or veterinary-acceptable carriers or excipients; and
   (d) an adjuvant.

2. The immunogenic composition as claimed in claim 1, wherein the MGF100-1L polypeptide is selected from the group consisting of: (SEQ ID NOS: 572, 570).

3. The immunogenic composition as claimed in claim 1, wherein according to (b) the heterologous viral or bacterial vector is selected from the group consisting avipox virus viral vector, canine morbillivirus viral vector, herpes virus viral vector, varicella virus viral vector, Lawsonia spp., *Salmonella* spp.

4. The immunogenic composition as claimed in claim 3, wherein according to (b) the heterologous viral or bacterial vector comprises one or two African swine fever virus oligonucleotides which encode African swine fever virus polypeptides, consisting of, an amino acid sequence which is at least identical to an amino acid sequence selected from the group consisting of: MGF100-1L (SEQ ID NOS: 572, 570).

5. The immunogenic composition as claimed in claim 3, wherein according to (b) the heterologous viral or bacterial vector comprises one or two African swine fever virus oligonucleotides which encode African swine fever virus polypeptides, wherein the one or two African swine fever virus oligonucleotides comprise, a nucleic acid sequence which is at least 95%, identical to a nucleic acid sequence selected from the group consisting of: MGF100-1L (SEQ ID NOS: 573, 571).

6. The immunogenic composition as claimed in claim 1, wherein the African swine fever virus polypeptide is an African swine fever virus full-length protein.

7. The immunogenic composition as claimed in claim 1, wherein the African swine fever virus is selected from the group consisting of: BA71, BA71ΔCD2 and/or Georgia2007/1 strain(s).

8. A kit comprising:
   (a) a dispenser capable of administering a vaccine to said porcine; and
   (b) the immunogenic composition as claimed in claim 1, and
   (c) optionally, an instruction leaflet.

9. The immunogenic composition as claimed in claim 1, wherein according to (d) the adjuvant is Freund's adjuvant.

* * * * *